United States Patent 10,619,170 (CRISPR-CAS SYSTEM FOR A YEAST HOST CELL) - sequence listing, part 4

SEQ ID NO: 5 - DNA, 11999069 bp, Saccharomyces cerevisiae CEN.PK113-7D (residues 5,999,536-7,999,380 of 11,999,069)
  misc_feature (205)..(2527): n is a, c, g, or t
  misc_feature (44386)..(44432): n is a, c, g, or t
  misc_feature (45928)..(45971): n is a, c, g, or t
  misc_feature (81641)..(81756): n is a, c, g, or t
  misc_feature (163081)..(174880): n is a, c, g, or t
  misc_feature (233286)..(233295): n is a, c, g, or t
  misc_feature (233896)..(234083): n is a, c, g, or t
  misc_feature (361462)..(372712): n is a, c, g, or t
  misc_feature (475262)..(475374): n is a, c, g, or t
  misc_feature (498298)..(498620): n is a, c, g, or t
  misc_feature (499040)..(499060): n is a, c, g, or t
  misc_feature (504686)..(504874): n is a, c, g, or t
  misc_feature (594168)..(594491): n is a, c, g, or t
  misc_feature (595072)..(595412): n is a, c, g, or t
  misc_feature (596424)..(596433): n is a, c, g, or t
  misc_feature (596712)..(596721): n is a, c, g, or t
  misc_feature (597302)..(598002): n is a, c, g, or t
  misc_feature (620254)..(620310): n is a, c, g, or t
  misc_feature (627246)..(627321): n is a, c, g, or t
  misc_feature (639566)..(639604): n is a, c, g, or t
  misc_feature (641524)..(641565): n is a, c, g, or t
  misc_feature (671276)..(671329): n is a, c, g, or t
  misc_feature (710578)..(710621): n is a, c, g, or t
  misc_feature (766972)..(767018): n is a, c, g, or t
  misc_feature (782945)..(783001): n is a, c, g, or t
  misc_feature (803273)..(803728): n is a, c, g, or t
  misc_feature (868403)..(868584): n is a, c, g, or t
  misc_feature (869252)..(869299): n is a, c, g, or t
  misc_feature (902796)..(903022): n is a, c, g, or t
  misc_feature (912357)..(912705): n is a, c, g, or t
  misc_feature (912944)..(913734): n is a, c, g, or t
  misc_feature (915178)..(915187): n is a, c, g, or t
  misc_feature (915499)..(915508): n is a, c, g, or t
  misc_feature (916239)..(916873): n is a, c, g, or t
  misc_feature (944978)..(944998): n is a, c, g, or t
  misc_feature (968410)..(968595): n is a, c, g, or t
  misc_feature (999644)..(999653): n is a, c, g, or t
  misc_feature (1001042)..(1001051): n is a, c, g, or t
  misc_feature (1025818)..(1025891): n is a, c, g, or t
  misc_feature (1162118)..(1167914): n is a, c, g, or t
  misc_feature (1185684)..(1185732): n is a, c, g, or t
  misc_feature (1243517)..(1243540): n is a, c, g, or t
  misc_feature (1277813)..(1278083): n is a, c, g, or t
  misc_feature (1314710)..(1315005): n is a, c, g, or t
  misc_feature (1355228)..(1363676): n is a, c, g, or t
  misc_feature (1364029)..(1392995): n is a, c, g, or t
  misc_feature (1393432)..(1394056): n is a, c, g, or t
  misc_feature (1475609)..(1475666): n is a, c, g, or t
  misc_feature (1496659)..(1502447): n is a, c, g, or t
  misc_feature (1539992)..(1540024): n is a, c, g, or t
  misc_feature (1554740)..(1560671): n is a, c, g, or t
  misc_feature (1590932)..(1591053): n is a, c, g, or t
  misc_feature (1591352)..(1591362): n is a, c, g, or t
  misc_feature (1602548)..(1602576): n is a, c, g, or t
  misc_feature (1635090)..(1635403): n is a, c, g, or t
  misc_feature (1667537)..(1667546): n is a, c, g, or t
  misc_feature (1692520)..(1692637): n is a, c, g, or t
  misc_feature (1726932)..(1727004): n is a, c, g, or t
  misc_feature (1755223)..(1755259): n is a, c, g, or t
  misc_feature (1774771)..(1774828): n is a, c, g, or t
  misc_feature (1785474)..(1785510): n is a, c, g, or t
  misc_feature (1794457)..(1794494): n is a, c, g, or t
  misc_feature (1874271)..(1885107): n is a, c, g, or t
  misc_feature (1889505)..(1889514): n is a, c, g, or t
  misc_feature (1940124)..(1940152): n is a, c, g, or t
  misc_feature (1951370)..(1951379): n is a, c, g, or t
  misc_feature (1963016)..(1963200): n is a, c, g, or t
  misc_feature (1963557)..(1963566): n is a, c, g, or t
  misc_feature (1964069)..(1964078): n is a, c, g, or t
  misc_feature (1966040)..(1966554): n is a, c, g, or t
  misc_feature (1967021)..(1967341): n is a, c, g, or t
  misc_feature (1968461)..(1969491): n is a, c, g, or t
  misc_feature (1970683)..(1970716): n is a, c, g, or t
  misc_feature (1971585)..(1972191): n is a, c, g, or t
  misc_feature (1972656)..(1972665): n is a, c, g, or t
  misc_feature (1992179)..(1992312): n is a, c, g, or t
  misc_feature (2006767)..(2006856): n is a, c, g, or t
  misc_feature (2049135)..(2049170): n is a, c, g, or t
  misc_feature (2054518)..(2054598): n is a, c, g, or t
  misc_feature (2112568)..(2112704): n is a, c, g, or t
  misc_feature (2114839)..(2114918): n is a, c, g, or t
  misc_feature (2134964)..(2134981): n is a, c, g, or t
  misc_feature (2187234)..(2187243): n is a, c, g, or t
  misc_feature (2256573)..(2256582): n is a, c, g, or t
  misc_feature (2355253)..(2355341): n is a, c, g, or t
  misc_feature (2435326)..(2435470): n is a, c, g, or t
  misc_feature (2450266)..(2450328): n is a, c, g, or t
  misc_feature (2478419)..(2478457): n is a, c, g, or t
  misc_feature (2481654)..(2481706): n is a, c, g, or t
  misc_feature (2487760)..(2487918): n is a, c, g, or t
  misc_feature (2541634)..(2541643): n is a, c, g, or t
  misc_feature (2628051)..(2630562): n is a, c, g, or t
  misc_feature (2631310)..(2631319): n is a, c, g, or t
  misc_feature (2631854)..(2631863): n is a, c, g, or t
  misc_feature (2632286)..(2634166): n is a, c, g, or t
  misc_feature (2634511)..(2635178): n is a, c, g, or t
  misc_feature (2638406)..(2638415): n is a, c, g, or t
  misc_feature (2639815)..(2639848): n is a, c, g, or t
  misc_feature (2696790)..(2696803): n is a, c, g, or t
  misc_feature (2728661)..(2728670): n is a, c, g, or t
  misc_feature (2739515)..(2739809): n is a, c, g, or t
  misc_feature (2773301)..(2773382): n is a, c, g, or t
  misc_feature (2816244)..(2822480): n is a, c, g, or t
  misc_feature (2869533)..(2869591): n is a, c, g, or t
  misc_feature (2908333)..(2908363): n is a, c, g, or t
  misc_feature (2973609)..(2973887): n is a, c, g, or t
  misc_feature (2974288)..(2974297): n is a, c, g, or t
  misc_feature (2992902)..(2993306): n is a, c, g, or t
  misc_feature (3043328)..(3043348): n is a, c, g, or t
  misc_feature (3055159)..(3055212): n is a, c, g, or t
  misc_feature (3074812)..(3074821): n is a, c, g, or t
  misc_feature (3076682)..(3076691): n is a, c, g, or t
  misc_feature (3091225)..(3094322): n is a, c, g, or t
  misc_feature (3094651)..(3102601): n is a, c, g, or t
  misc_feature (3144421)..(3144491): n is a, c, g, or t
  misc_feature (3159228)..(3159997): n is a, c, g, or t
  misc_feature (3195677)..(3195691): n is a, c, g, or t
  misc_feature (3258209)..(3258419): n is a, c, g, or t
  misc_feature (3281281)..(3281481): n is a, c, g, or t
  misc_feature (3289944)..(3290004): n is a, c, g, or t
  misc_feature (3320671)..(3321188): n is a, c, g, or t
  misc_feature (3331355)..(3331603): n is a, c, g, or t
  misc_feature (3331866)..(3331875): n is a, c, g, or t
  misc_feature (3332825)..(3333247): n is a, c, g, or t
  misc_feature (3333794)..(3333954): n is a, c, g, or t
  misc_feature (3347120)..(3363602): n is a, c, g, or t
  misc_feature (3365565)..(3376501): n is a, c, g, or t
  misc_feature (3376811)..(3380583): n is a, c, g, or t
  misc_feature (3381762)..(3383298): n is a, c, g, or t
  misc_feature (3420545)..(3422114): n is a, c, g, or t
  misc_feature (3423622)..(3426778): n is a, c, g, or t
  misc_feature (3499871)..(3499882): n is a, c, g, or t
  misc_feature (3500521)..(3500530): n is a, c, g, or t
  misc_feature (3526350)..(3526367): n is a, c, g, or t
  misc_feature (3557063)..(3557072): n is a, c, g, or t
  misc_feature (3625021)..(3625067): n is a, c, g, or t
  misc_feature (3677020)..(3677057): n is a, c, g, or t
  misc_feature (3693178)..(3693223): n is a, c, g, or t
  misc_feature (3741420)..(3741429): n is a, c, g, or t
  misc_feature (3741746)..(3741755): n is a, c, g, or t
  misc_feature (3745978)..(3745987): n is a, c, g, or t
  misc_feature (3752623)..(3752656): n is a, c, g, or t
  misc_feature (3753805)..(3753916): n is a, c, g, or t
  misc_feature (3800996)..(3807228): n is a, c, g, or t
  misc_feature (3867488)..(3867512): n is a, c, g, or t
  misc_feature (3924622)..(3924934): n is a, c, g, or t
  misc_feature (3943036)..(3943045): n is a, c, g, or t
  misc_feature (3944062)..(3944117): n is a, c, g, or t
  misc_feature (3977549)..(3977558): n is a, c, g, or t
  misc_feature (3986649)..(3986913): n is a, c, g, or t
  misc_feature (4064698)..(4066091): n is a, c, g, or t
  misc_feature (4095364)..(4095746): n is a, c, g, or t
  misc_feature (4098982)..(4098991): n is a, c, g, or t
  misc_feature (4141332)..(4141391): n is a, c, g, or t
  misc_feature (4153885)..(4154014): n is a, c, g, or t
  misc_feature (4168860)..(4174683): n is a, c, g, or t
  misc_feature (4178481)..(4178490): n is a, c, g, or t
  misc_feature (4202100)..(4202109): n is a, c, g, or t
  misc_feature (4202416)..(4202425): n is a, c, g, or t
  misc_feature (4202758)..(4203311): n is a, c, g, or t
  misc_feature (4208564)..(4214472): n is a, c, g, or t
  misc_feature (4214816)..(4221031): n is a, c, g, or t
  misc_feature (4233235)..(4233305): n is a, c, g, or t
  misc_feature (4240413)..(4240472): n is a, c, g, or t
  misc_feature (4306916)..(4306925): n is a, c, g, or t
  misc_feature (4328320)..(4328712): n is a, c, g, or t
  misc_feature (4340090)..(4340099): n is a, c, g, or t
  misc_feature (4340461)..(4340470): n is a, c, g, or t
  misc_feature (4342720)..(4344153): n is a, c, g, or t
  misc_feature (4346464)..(4346643): n is a, c, g, or t
  misc_feature (4348250)..(4348471): n is a, c, g, or t
  misc_feature (4471451)..(4477404): n is a, c, g, or t
  misc_feature (4533358)..(4533497): n is a, c, g, or t
  misc_feature (4617992)..(4618023): n is a, c, g, or t
  misc_feature (4661127)..(4661383): n is a, c, g, or t
  misc_feature (4672227)..(4672332): n is a, c, g, or t
  misc_feature (4796633)..(4796677): n is a, c, g, or t
  misc_feature (4808412)..(4808456): n is a, c, g, or t
  misc_feature (4832325)..(4832370): n is a, c, g, or t
  misc_feature (4840231)..(4840325): n is a, c, g, or t
  misc_feature (4892532)..(4894744): n is a, c, g, or t
  misc_feature (4911796)..(4917647): n is a, c, g, or t
  misc_feature (4970685)..(4970703): n is a, c, g, or t
  misc_feature (5021282)..(5027134): n is a, c, g, or t
  misc_feature (5039888)..(5039897): n is a, c, g, or t
  misc_feature (5061345)..(5061354): n is a, c, g, or t
  misc_feature (5140122)..(5140131): n is a, c, g, or t
  misc_feature (5166542)..(5166551): n is a, c, g, or t
  misc_feature (5167261)..(5167270): n is a, c, g, or t
  misc_feature (5261635)..(5261655): n is a, c, g, or t
  misc_feature (5287399)..(5293375): n is a, c, g, or t
  misc_feature (5318126)..(5318173): n is a, c, g, or t
  misc_feature (5348589)..(5348621): n is a, c, g, or t
  misc_feature (5395087)..(5395233): n is a, c, g, or t
  misc_feature (5395557)..(5395588): n is a, c, g, or t
  misc_feature (5395827)..(5395866): n is a, c, g, or t
  misc_feature (5396620)..(5396629): n is a, c, g, or t
  misc_feature (5397322)..(5398079): n is a, c, g, or t
  misc_feature (5398391)..(5399129): n is a, c, g, or t
  misc_feature (5399763)..(5399772): n is a, c, g, or t
  misc_feature (5402565)..(5402594): n is a, c, g, or t
  misc_feature (5403245)..(5411575): n is a, c, g, or t
  misc_feature (5459021)..(5459039): n is a, c, g, or t
  misc_feature (5492249)..(5496564): n is a, c, g, or t
  misc_feature (5497274)..(5498143): n is a, c, g, or t
  misc_feature (5648026)..(5648062): n is a, c, g, or t
  misc_feature (5648923)..(5648932): n is a, c, g, or t
  misc_feature (5679128)..(5679137): n is a, c, g, or t
  misc_feature (5739683)..(5739708): n is a, c, g, or t
  misc_feature (5752652)..(5752661): n is a, c, g, or t
  misc_feature (5754987)..(5755029): n is a, c, g, or t
  misc_feature (5787779)..(5787813): n is a, c, g, or t
  misc_feature (5809061)..(5809070): n is a, c, g, or t
  misc_feature (5810680)..(5810751): n is a, c, g, or t
  misc_feature (5825247)..(5825381): n is a, c, g, or t
  misc_feature (5875057)..(5875092): n is a, c, g, or t
  misc_feature (5882070)..(5882227): n is a, c, g, or t
  misc_feature (5888651)..(5888698): n is a, c, g, or t
  misc_feature (5892024)..(5892096): n is a, c, g, or t
  misc_feature (5894021)..(5894076): n is a, c, g, or t
  misc_feature (5897382)..(5897399): n is a, c, g, or t
  misc_feature (5914919)..(5917786): n is a, c, g, or t
  misc_feature (5918097)..(5920417): n is a, c, g, or t
  misc_feature (5942134)..(5942446): n is a, c, g, or t
  misc_feature (5956982)..(5963365): n is a, c, g, or t
  misc_feature (5965545)..(5965554): n is a, c, g, or t
  misc_feature (5965896)..(5965905): n is a, c, g, or t
  misc_feature (5966394)..(5967458): n is a, c, g, or t
  misc_feature (5968186)..(5969324): n is a, c, g, or t
  misc_feature (5993697)..(5993706): n is a, c, g, or t
  misc_feature (5994847)..(5994856): n is a, c, g, or t
  misc_feature (5995606)..(5995615): n is a, c, g, or t
  misc_feature (5996681)..(5996690): n is a, c, g, or t
  misc_feature (5997179)..(5997519): n is a, c, g, or t
  misc_feature (5999799)..(5999843): n is a, c, g, or t
  misc_feature (6031305)..(6031346): n is a, c, g, or t
  misc_feature (6061367)..(6061505): n is a, c, g, or t
  misc_feature (6062870)..(6062895): n is a, c, g, or t
  misc_feature (6099845)..(6099902): n is a, c, g, or t
  misc_feature (6122169)..(6122366): n is a, c, g, or t
  misc_feature (6146818)..(6146827): n is a, c, g, or t
  misc_feature (6147525)..(6147534): n is a, c, g, or t
  misc_feature (6163386)..(6178290): n is a, c, g, or t
  misc_feature (6195480)..(6195489): n is a, c, g, or t
  misc_feature (6196302)..(6196761): n is a, c, g, or t
  misc_feature (6197179)..(6197432): n is a, c, g, or t
  misc_feature (6258062)..(6258158): n is a, c, g, or t
  misc_feature (6260714)..(6260736): n is a, c, g, or t
  misc_feature (6262813)..(6262909): n is a, c, g, or t
  misc_feature (6269624)..(6269664): n is a, c, g, or t
  misc_feature (6304253)..(6304288): n is a, c, g, or t
  misc_feature (6329435)..(6329511): n is a, c, g, or t
  misc_feature (6369465)..(6369511): n is a, c, g, or t
  misc_feature (6379954)..(6380014): n is a, c, g, or t
  misc_feature (6590763)..(6590959): n is a, c, g, or t
  misc_feature (6591761)..(6592147): n is a, c, g, or t
  misc_feature (6592862)..(6593217): n is a, c, g, or t
  misc_feature (6720747)..(6720796): n is a, c, g, or t
  misc_feature (6724027)..(6724325): n is a, c, g, or t
  misc_feature (6724576)..(6730479): n is a, c, g, or t
  misc_feature (6750715)..(6756572): n is a, c, g, or t
  misc_feature (6757573)..(6759539): n is a, c, g, or t
  misc_feature (6763105)..(6763508): n is a, c, g, or t
  misc_feature (6771910)..(6771929): n is a, c, g, or t
  misc_feature (6791324)..(6791337): n is a, c, g, or t
  misc_feature (6800272)..(6800481): n is a, c, g, or t
  misc_feature (6888678)..(6888703): n is a, c, g, or t
  misc_feature (6895882)..(6896220): n is a, c, g, or t
  misc_feature (6900918)..(6901231): n is a, c, g, or t
  misc_feature (6924669)..(6925006): n is a, c, g, or t
  misc_feature (6931184)..(6931228): n is a, c, g, or t
  misc_feature (6952508)..(6952815): n is a, c, g, or t
  misc_feature (6953148)..(6953157): n is a, c, g, or t
  misc_feature (6953712)..(6953721): n is a, c, g, or t
  misc_feature (6954400)..(6954466): n is a, c, g, or t
  misc_feature (6997493)..(6997502): n is a, c, g, or t
  misc_feature (7000160)..(7007168): n is a, c, g, or t
  misc_feature (7007426)..(7012014): n is a, c, g, or t
  misc_feature (7120372)..(7120384): n is a, c, g, or t
  misc_feature (7137844)..(7137878): n is a, c, g, or t
  misc_feature (7139950)..(7139987): n is a, c, g, or t
  misc_feature (7156736)..(7156788): n is a, c, g, or t
  misc_feature (7232451)..(7232470): n is a, c, g, or t
  misc_feature (7267316)..(7267886): n is a, c, g, or t
  misc_feature (7268847)..(7268889): n is a, c, g, or t
  misc_feature (7269429)..(7269636): n is a, c, g, or t
  misc_feature (7269935)..(7269951): n is a, c, g, or t
  misc_feature (7270484)..(7270788): n is a, c, g, or t
  misc_feature (7275847)..(7276292): n is a, c, g, or t
  misc_feature (7276567)..(7276576): n is a, c, g, or t
  misc_feature (7277068)..(7277077): n is a, c, g, or t
  misc_feature (7321152)..(7321289): n is a, c, g, or t
  misc_feature (7358769)..(7358817): n is a, c, g, or t
  misc_feature (7362636)..(7362653): n is a, c, g, or t
  misc_feature (7367764)..(7367823): n is a, c, g, or t
  misc_feature (7400860)..(7406299): n is a, c, g, or t
  misc_feature (7440914)..(7441098): n is a, c, g, or t
  misc_feature (7444170)..(7444228): n is a, c, g, or t
  misc_feature (7446715)..(7446728): n is a, c, g, or t
  misc_feature (7473211)..(7473242): n is a, c, g, or t
  misc_feature (7533218)..(7538398): n is a, c, g, or t
  misc_feature (7593007)..(7593362): n is a, c, g, or t
  misc_feature (7617361)..(7617557): n is a, c, g, or t
  misc_feature (7666494)..(7666774): n is a, c, g, or t
  misc_feature (7706514)..(7706653): n is a, c, g, or t
  misc_feature (7720385)..(7720428): n is a, c, g, or t
  misc_feature (7727199)..(7727262): n is a, c, g, or t
  misc_feature (7729487)..(7729544): n is a, c, g, or t
  misc_feature (7756776)..(7757013): n is a, c, g, or t
  misc_feature (7836553)..(7836640): n is a, c, g, or t
  misc_feature (7843009)..(7843108): n is a, c, g, or t
  misc_feature (7885148)..(7885356): n is a, c, g, or t
  misc_feature (7893877)..(7894489): n is a, c, g, or t
  misc_feature (7934507)..(7934605): n is a, c, g, or t
  misc_feature (7965027)..(7965759): n is a, c, g, or t
  misc_feature (7974501)..(7980753): n is a, c, g, or t
  misc_feature (8018624)..(8018931): n is a, c, g, or t
  misc_feature (8023503)..(8029062): n is a, c, g, or t
  misc_feature (8075966)..(8075981): n is a, c, g, or t
  misc_feature (8101105)..(8101204): n is a, c, g, or t
  misc_feature (8102080)..(8102089): n is a, c, g, or t
  misc_feature (8102364)..(8102696): n is a, c, g, or t
  misc_feature (8102913)..(8103214): n is a, c, g, or t
  misc_feature (8103941)..(8103950): n is a, c, g, or t
  misc_feature (8116421)..(8116430): n is a, c, g, or t
  misc_feature (8116874)..(8116883): n is a, c, g, or t
  misc_feature (8117158)..(8117648): n is a, c, g, or t
  misc_feature (8120864)..(8120949): n is a, c, g, or t
  misc_feature (8144861)..(8145420): n is a, c, g, or t
  misc_feature (8223914)..(8223923): n is a, c, g, or t
  misc_feature (8326977)..(8327041): n is a, c, g, or t
  misc_feature (8373884)..(8373918): n is a, c, g, or t
  misc_feature (8471232)..(8471278): n is a, c, g, or t
  misc_feature (8572264)..(8572356): n is a, c, g, or t
  misc_feature (8573326)..(8573335): n is a, c, g, or t
  misc_feature (8596432)..(8596573): n is a, c, g, or t
  misc_feature (8613678)..(8619990): n is a, c, g, or t
  misc_feature (8620638)..(8628769): n is a, c, g, or t
  misc_feature (8688269)..(8688308): n is a, c, g, or t
  misc_feature (8707494)..(8707539): n is a, c, g, or t
  misc_feature (8728662)..(8728704): n is a, c, g, or t
  misc_feature (8731205)..(8731240): n is a, c, g, or t
  misc_feature (8731834)..(8731892): n is a, c, g, or t
  misc_feature (8752265)..(8752326): n is a, c, g, or t
  misc_feature (8771873)..(8771903): n is a, c, g, or t
  misc_feature (8851401)..(8861738): n is a, c, g, or t
  misc_feature (8972109)..(8978299): n is a, c, g, or t
  misc_feature (8978580)..(8984473): n is a, c, g, or t
  misc_feature (8992934)..(8992993): n is a, c, g, or t
  misc_feature (9028265)..(9028374): n is a, c, g, or t
  misc_feature (9031349)..(9031448): n is a, c, g, or t
  misc_feature (9081547)..(9092733): n is a, c, g, or t
  misc_feature (9174845)..(9174905): n is a, c, g, or t
  misc_feature (9195859)..(9201769): n is a, c, g, or t
  misc_feature (9238350)..(9238386): n is a, c, g, or t
  misc_feature (9254403)..(9256112): n is a, c, g, or t
  misc_feature (9259790)..(9261506): n is a, c, g, or t
  misc_feature (9306805)..(9312705): n is a, c, g, or t
  misc_feature (9339145)..(9339171): n is a, c, g, or t
  misc_feature (9343321)..(9343330): n is a, c, g, or t
  misc_feature (9345863)..(9345872): n is a, c, g, or t
  misc_feature (9350863)..(9350872): n is a, c, g, or t
  misc_feature (9354674)..(9354708): n is a, c, g, or t
  misc_feature (9407736)..(9408709): n is a, c, g, or t
  misc_feature (9422125)..(9422134): n is a, c, g, or t
  misc_feature (9452776)..(9453061): n is a, c, g, or t
  misc_feature (9457486)..(9457638): n is a, c, g, or t
  misc_feature (9483727)..(9483779): n is a, c, g, or t
  misc_feature (9622958)..(9623434): n is a, c, g, or t
  misc_feature (9623714)..(9623757): n is a, c, g, or t
  misc_feature (9624437)..(9624505): n is a, c, g, or t
  misc_feature (9624848)..(9624912): n is a, c, g, or t
  misc_feature (9629940)..(9629949): n is a, c, g, or t
  misc_feature (9630619)..(9630628): n is a, c, g, or t
  misc_feature (9630946)..(9630955): n is a, c, g, or t
  misc_feature (9631482)..(9631511): n is a, c, g, or t
  misc_feature (9632870)..(9632879): n is a, c, g, or t
  misc_feature (9633302)..(9633840): n is a, c, g, or t
  misc_feature (9636461)..(9636470): n is a, c, g, or t
  misc_feature (9636753)..(9639148): n is a, c, g, or t
  misc_feature (9675363)..(9675598): n is a, c, g, or t
  misc_feature (9684991)..(9685033): n is a, c, g, or t
  misc_feature (9707837)..(9708153): n is a, c, g, or t
  misc_feature (9709196)..(9709523): n is a, c, g, or t
  misc_feature (9709815)..(9715750): n is a, c, g, or t
  misc_feature (9718278)..(9718287): n is a, c, g, or t
  misc_feature (9755015)..(9755480): n is a, c, g, or t
  misc_feature (9773951)..(9776620): n is a, c, g, or t
  misc_feature (9793427)..(9794419): n is a, c, g, or t
  misc_feature (9806315)..(9806324): n is a, c, g, or t
  misc_feature (9823552)..(9823561): n is a, c, g, or t
  misc_feature (9824293)..(9824302): n is a, c, g, or t
  misc_feature (9825006)..(9825779): n is a, c, g, or t
  misc_feature (9836087)..(9836150): n is a, c, g, or t
  misc_feature (9877326)..(9877350): n is a, c, g, or t
  misc_feature (9884775)..(9884874): n is a, c, g, or t
  misc_feature (9893618)..(9893877): n is a, c, g, or t
  misc_feature (9894717)..(9894731): n is a, c, g, or t
  misc_feature (9917333)..(9917388): n is a, c, g, or t
  misc_feature (9917772)..(9918477): n is a, c, g, or t
  misc_feature (9919120)..(9919228): n is a, c, g, or t
  misc_feature (9928928)..(9928941): n is a, c, g, or t
  misc_feature (9929298)..(9929799): n is a, c, g, or t
  misc_feature (9946081)..(9946165): n is a, c, g, or t
  misc_feature (9946581)..(9946597): n is a, c, g, or t
  misc_feature (9947401)..(9947788): n is a, c, g, or t
  misc_feature (9958851)..(9958901): n is a, c, g, or t
  misc_feature (9967765)..(9973519): n is a, c, g, or t
  misc_feature (9973790)..(9974028): n is a, c, g, or t
  misc_feature (9980907)..(9980944): n is a, c, g, or t
  misc_feature (10026359)..(10026458): n is a, c, g, or t
  misc_feature (10027066)..(10027075): n is a, c, g, or t
  misc_feature (10053388)..(10053397): n is a, c, g, or t
  misc_feature (10097799)..(10097928): n is a, c, g, or t
  misc_feature (10103851)..(10103882): n is a, c, g, or t
  misc_feature (10135097)..(10135106): n is a, c, g, or t
  misc_feature (10135335)..(10135434): n is a, c, g, or t
  misc_feature (10135815)..(10135959): n is a, c, g, or t
  misc_feature (10159072)..(10170681): n is a, c, g, or t
  misc_feature (10238177)..(10239187): n is a, c, g, or t
  misc_feature (10285431)..(10285443): n is a, c, g, or t
  misc_feature (10291557)..(10291625): n is a, c, g, or t
  misc_feature (10413759)..(10415618): n is a, c, g, or t
  misc_feature (10416997)..(10417006): n is a, c, g, or t
  misc_feature (10426773)..(10426787): n is a, c, g, or t
  misc_feature (10429149)..(10429192): n is a, c, g, or t
  misc_feature (10439036)..(10439093): n is a, c, g, or t
  misc_feature (10489671)..(10489721): n is a, c, g, or t
  misc_feature (10501011)..(10501054): n is a, c, g, or t
  misc_feature (10529737)..(10530029): n is a, c, g, or t
  misc_feature (10571948)..(10571957): n is a, c, g, or t
  misc_feature (10582546)..(10582931): n is a, c, g, or t
  misc_feature (10597185)..(10597292): n is a, c, g, or t
  misc_feature (10598066)..(10598246): n is a, c, g, or t
  misc_feature (10598854)..(10598935): n is a, c, g, or t
  misc_feature (10638269)..(10638294): n is a, c, g, or t
  misc_feature (10640015)..(10640114): n is a, c, g, or t
  misc_feature (10747394)..(10748191): n is a, c, g, or t
  misc_feature (10748433)..(10748953): n is a, c, g, or t
  misc_feature (10749266)..(10750425): n is a, c, g, or t
  misc_feature (10751440)..(10763012): n is a, c, g, or t
  misc_feature (10763590)..(10776080): n is a, c, g, or t
  misc_feature (10776305)..(10776896): n is a, c, g, or t
  misc_feature (10777120)..(10778295): n is a, c, g, or t
  misc_feature (10782285)..(10782384): n is a, c, g, or t
  misc_feature (10821861)..(10821930): n is a, c, g, or t
  misc_feature (10852263)..(10852308): n is a, c, g, or t
  misc_feature (10864007)..(10864104): n is a, c, g, or t
  misc_feature (10890818)..(10891956): n is a, c, g, or t
  misc_feature (10921593)..(10927725): n is a, c, g, or t
  misc_feature (10933419)..(10933731): n is a, c, g, or t
  misc_feature (10938154)..(10938163): n is a, c, g, or t
  misc_feature (10938552)..(10938561): n is a, c, g, or t
  misc_feature (10939264)..(10939273): n is a, c, g, or t
  misc_feature (10939630)..(10939639): n is a, c, g, or t
  misc_feature (10941167)..(10941209): n is a, c, g, or t
  misc_feature (10958833)..(10959654): n is a, c, g, or t
  misc_feature (10961672)..(10972136): n is a, c, g, or t
  misc_feature (10973419)..(10973656): n is a, c, g, or t
  misc_feature (10974306)..(10980893): n is a, c, g, or t
  misc_feature (10982885)..(10985369): n is a, c, g, or t
  misc_feature (10986878)..(10989437): n is a, c, g, or t
  misc_feature (10991176)..(10991588): n is a, c, g, or t
  misc_feature (11003127)..(11003155): n is a, c, g, or t
  misc_feature (11060311)..(11060320): n is a, c, g, or t
  misc_feature (11128945)..(11129061): n is a, c, g, or t
  misc_feature (11135443)..(11135509): n is a, c, g, or t
  misc_feature (11153614)..(11153746): n is a, c, g, or t
  misc_feature (11170636)..(11176434): n is a, c, g, or t
  misc_feature (11206821)..(11207195): n is a, c, g, or t
  misc_feature (11226025)..(11226054): n is a, c, g, or t
  misc_feature (11239845)..(11240029): n is a, c, g, or t
  misc_feature (11290546)..(11290618): n is a, c, g, or t
  misc_feature (11305342)..(11305395): n is a, c, g, or t
  misc_feature (11357221)..(11358451): n is a, c, g, or t
  misc_feature (11397504)..(11397513): n is a, c, g, or t
  misc_feature (11397970)..(11397979): n is a, c, g, or t
  misc_feature (11398395)..(11398404): n is a, c, g, or t
  misc_feature (11398867)..(11398876): n is a, c, g, or t
  misc_feature (11399540)..(11400002): n is a, c, g, or t
  misc_feature (11406110)..(11408919): n is a, c, g, or t
  misc_feature (11436727)..(11436891): n is a, c, g, or t
  misc_feature (11450476)..(11450531): n is a, c, g, or t
  misc_feature (11480581)..(11480595): n is a, c, g, or t
  misc_feature (11484495)..(11484636): n is a, c, g, or t
  misc_feature (11490121)..(11490663): n is a, c, g, or t
  misc_feature (11521176)..(11521532): n is a, c, g, or t
  misc_feature (11531757)..(11531766): n is a, c, g, or t
  misc_feature (11532067)..(11532085): n is a, c, g, or t
  misc_feature (11545189)..(11545411): n is a, c, g, or t
  misc_feature (11556271)..(11556358): n is a, c, g, or t
  misc_feature (11611104)..(11614983): n is a, c, g, or t
  misc_feature (11635688)..(11635697): n is a, c, g, or t
  misc_feature (11636582)..(11636678): n is a, c, g, or t
  misc_feature (11659473)..(11659495): n is a, c, g, or t
  misc_feature (11682512)..(11682522): n is a, c, g, or t
  misc_feature (11683185)..(11683390): n is a, c, g, or t
  misc_feature (11691922)..(11692036): n is a, c, g, or t
  misc_feature (11738737)..(11738803): n is a, c, g, or t
  misc_feature (11784794)..(11784815): n is a, c, g, or t
  misc_feature (11787917)..(11788269): n is a, c, g, or t
  misc_feature (11850466)..(11850475): n is a, c, g, or t
  misc_feature (11864577)..(11864586): n is a, c, g, or t
  misc_feature (11907589)..(11907627): n is a, c, g, or t
  misc_feature (11913649)..(11913669): n is a, c, g, or t
  misc_feature (11924239)..(11924248): n is a, c, g, or t
  misc_feature (11924530)..(11924623): n is a, c, g, or t
  misc_feature (11925177)..(11926002): n is a, c, g, or t
  misc_feature (11926579)..(11926588): n is a, c, g, or t
  misc_feature (11938581)..(11938590): n is a, c, g, or t
  misc_feature (11940311)..(11941846): n is a, c, g, or t
  misc_feature (11942271)..(11948571): n is a, c, g, or t
  misc_feature (11949572)..(11949581): n is a, c, g, or t
  misc_feature (11952183)..(11952192): n is a, c, g, or t
  misc_feature (11952741)..(11952794): n is a, c, g, or t
  misc_feature (11953652)..(11953759): n is a, c, g, or t
  misc_feature (11954154)..(11954163): n is a, c, g, or t
  misc_feature (11954566)..(11954575): n is a, c, g, or t
  misc_feature (11955322)..(11955331): n is a, c, g, or t
  misc_feature (11978263)..(11978263): n is a, c, g, or t
cttcccatttcaaggcagaaacttgagaaccggttggggtaaggaaagatcaaattttatgccacagcagcagcaacagggcggtcagccacttataatgaatgaccaacaacaaccggttatgtctgagcaacaacagcaacagcagcaacagcagcaacaacaataaatattatgaagaaaagtggaatgaaacaaaaagaaagaataaagagaggcaacctacaaatcccaagataaaataaaaaaagaacgacaagaatnnnnnnnnnnnnnnnnnnnnnnnnnnnnnnnnnnnnnnnnnnnnnaaaagggagaagaaaaagaagaagaaactcaatttactattgctcgaaaaataaaagggcctataaacttactctatttttttagtttttctgtgtcttatttccttccttcgtcactgtttaatttttaatactattattttcctttaaaatgtgaaagtcattgctaatagtgtgataaaaataaagaacgtattttctgaaggctttctttattatatttcctttttcctttcttaccctattttttttaaacatccatcccactgtattttgtcgagtccatatatataatttttgtttttattttttacaacttttgttaagtatataaaaatgctacctagcgttatggagacatgtcagtcttgagtccaggcacataaaggcaacagccactaccactgcgcacccgtgacgctgctccaacgttctcattaagtacggaactgtgtttcgaacaaaagaatggctgttaagaccaaaaaaaaggcagcttaacaggaacccggctggttccacaggacttttctttctttagggaaaggttgtgaaaatgacaaccaaaaagtcgcgacgccaaatatcaaaaacctagatgatattacttcgtctgccaaacacctcctttccctctatccagcccttattttttttccaagagcttcatatgcacgcccgaatcatttcgaatcgcgtacgtggcaggttgtggctggcatctttcccaaaaggaaacggaccaataccacgcatccccgagctcttggtctttctttatcttgcatagcccaaaaaataaaatggggcgggaaaaagggggcatatcagagcatcgggaacttctttcaatgcaatatatatggcacatataaaaaattctggcttcattatgttaggtgcagagattccgtttagaccaattgaacggtaaccagaaggtaatcttaaatatacaaacaaaaaacaaggtccataatgacaaagaatttcatcgtcactttgaaaaagaacactccagatgtggaagctaagaagttcttggattcagtccatcacgcaggtggctctattgtacacaaattcgacatcattaaagggtacaccatcaaggtaccagatgttctccacttgaacaagttgaaggaaaagcacaatgatgtcatcgagaacgtcgaagaagacaaagaagttcatacaaattgattcctgagataaacgcaaacacttttttactcggaaattttctctccccgattgtaaatttatttctcgtctactataataattcaccaaaaaacaagcagagcacgtcctatatatatatatatatatatatatatatatacatatatatatacgaatatatttatgacagtctaaatcgttgctcctgttcaattttaacgctcttttataactgctgtggcgccatttctttggcatctaagatgtgtctcgggactttctttttctggtcatcttgctttccttgccttgtcattaacagagctaaactgtgttgaggaagtggtcttttaaattttcaaggtcgcggcccgtgcattgcgcggctggatgtcttttaggggagcgatgcgcttgcacaaaagaatagccttgatttccgctattaatgggtatattcttctaacaatttgagttttttctccacttgtttctttcttctttctcttttccattcacattttgctttacttttctggataatatatatgtgcatatatatatatccatttaaatatatatatatatatatcttttgtcctcctctccagttacttttgcgccagaaattccttcttcttttcaatctaatagagaagggtagatagtgtggtgcaaaaaaagagccttttaaaccaaaaataaataaaaaaaaggaatcacaaaatgtcagattcacaacaatcaatcaccgttctagaagagcttttccgaaagttggaaactgctacttcagaaacaagagagggtatttcttcggagctttcctcatttttaaacgggaacatcatcgagcatgacgttcccgaagttttttttgatgaatttcaaaaagctatccagagtaaacaaaaggcgctcaacacgctgggtgcggtggcttacatagcaaatgaaactaatctatcaccttctgttgaaccgtacatagttgcgacggtcccttctgtatgcagtaaagctggtagtaaagataatgatgttcaacttgcggcaacaaaggccctcaaagccatcgctagtgctgttaacccggttgccgttaaagcactcttacctcatttgattcattcgctggaaactagcaacaagtggaaagagaaggttgctgttctcgaagtaatctctgtattggtagatgccgctaaagaacagattgccttaagaatgccggaactaattcccgttctttcggaatccatgtgggacactaagaaaggagttaaggaggcggcaacgacaaccatcacaaaggcaactgaaactgttgataataaggatattgagagatttattccaaaattaatcgaatgtattgcaaatccaaatgaggtgcctgaaaccgttcatctcttgggtgcaactacttttgtagccgaagtaactccagcgactttgtctattatggttcctttattgagcagaggtttagccgagagagaaacctctataaaacgtaaagctgcggttattatcgataatatgtgtaaattggttgaagacccgcaagttgttgctccattcttaggtaaactactaccagggctaaagaacaattttgctactattgctgatcctgaagcgcgtgaagttacattaaaagctttaaaaaccctgagacgtgtgggtaatgtcggggaagatgatgtgttaccagaaatatcgcatgctggtgatgtttccacaacactgggcgtcatcaaggaattactggaacctgaaaaagtggccccaaggttcaccattgtggttgagtacatagccgcgattgccgcaaatctaattgatgaaaggatcattgatcagcaaacgtggtttacacatgttacaccttatatgactatatttttacatgagaaaactgcaaaggaaatactagacgatttcaggaaaagggcagtagataatattccagttggaccgaatttccaagacgaagaggatgagggtgaagatttgtgtaattgtgaattttccttggcatatggtgccaaaatattactaaacaagactcaattgaggttgaagcgaggtaggagatatggtctatgtggtcctaatggtgccggaaaatccactctaatgcgatccattgctaatggccaagttgacgggttccccactcaggatgaatgtcgcactgtttatgtggaacacgatatcgataatacacattcggacatgtccgttttagattttgtatattccggcaatgtaggaactaaggatgttattacctcgaaattaaaggagtttgggttcagcgatgaaatgatagaaatgccaattgcatccctatctggaggttggaaaatgaaattagctttggcgagggctgttctgaaggacgctgacattctactattggatgaaccaacaaatcatctagacactgttaatgtggagtggctggtaaattatttgaatacttgcggaattacatcggtgattgtctctcatgattctggttttctggataaggtttgtcaatacatcatacattatgagggtcttaaattaagaaagtacaagggtaatttatcagaatttgttcaaaaatgtcctacggcacaatcatactatgaattaggtgcctctgaccttgaatttcaattcccaactcctggttatctagaaggtgtcaaaacgaagcaaaaggcaattgttaaagtaagtaatatgacttttcaatatccagggacaactaaaccacaagtctcagatgttactttccagtgttctctatcctcaaggattgcagttatcggacctaatggggctggtaagtccactttaattaatgttcttactggtgaactgttaccaaccagcggtgaagtatatacacacgagaattgtcgtatagcgtatattaagcagcacgcttttgcacacattgaatcgcacttagacaaaactccatccgaatacattcaatggaggttccaaactggtgaggatagggaaacaatggatagagcaaataggcaaataaatgaaaatgacgcagaggccatgaataaaatatttaaaattgaagggaccccaagaagggttgcaggaatccattcaagaaggaaatttaaaaacacgtatgagtacgaatgttcgtttttgttaggtgagaacattggtatgaaatctgaaagatgggttccaatgatgtctgtcgacaatgcttggctaccaaggggcgaattgattgaatcccattctaaaatggttgctgaaattgatatgaaggaagctttggcttctggtcaattcagggctttaacaagaaaagagattgaattacattgcgccatgttggggttggattcagaattagtctcacattcaagaattagaggtttatcgggtgggcaaaaggttaaattggtactcgctgcctgcacgtggcaaagaccccatttgattgttttagatgaacctacgaattacttggacagagattcattgggtgctctttcaaaagcattaaaagcttttgaaggtggtgtcattattattacgcattcggcagaatttactaagaatctgactgacgaagtttgggcggttaaggatgggaaaatgacaccctctggccataattgggttgcaggacaaggtgctggcccaagaattgagaaaaaagaagaagagggtgataaatttgatgctatgggtaacaagattaatagtgggaagaaaaaaagcaaactctcttctgcagaattgagaaagaaaaagaaggagagaatgaagaagaaaaaagagatgggtgatgaatacgtttcttctgatgaagatttttaatttgaagtcgagtacatctctttcagtgagtaacttatatatttttgaagttaacatccttattctttttttatatttttattttttttatgtttattttctattactgattttcacaaagaaaggtaaaaaaaaacatacttcagcggctatacaaccatatttaagtaaatgcactcagagaaagtatacaagtaaaaaacctaagtaaagacataaatatcccaaaataatgcaaaaactcctctttgtcttttctgtgttattgacagtagtactagcaacagcaccatttcaggtacaatgtcctagctctccacttattagggaggccaaagtaagttaaactctttgccactttaacaaatatgggccaaaactaaccgaatataccaaaacttcgtattcctttgtttattagcatgaactctgtccagaagaaaccttgtatctgaagaaaaaaaaaattaaaacgaagaataaactgattcagtttttaaaatccttgacagaggcaaagtttagttcgaagttttataaacgcgtgttgaaagatcctccaaaaattgggattgctatatctggcggcgggtacagatccatgttagtaggtaccggatttatttcccaaatgaacgattatggcctttttgaatattcggattatattgctggattatcaggcggaagttggatcttgatggatttggtagttcaaaattttgaagtaaaatccctgctacaagagtgggaccttgaagaggatcttttattaggcataccggaattcgatatttccgaagaagaaattgttaccaatgcaaaaaaggagtataatgataatgatttgaagatgaagaagcgtcaggggggttctctgattacaagctcttcaaatttttatgaacaaatagaggagatcatgaattccatagaagaaatcccagaagactatatgataacgaagagaaacttgaatccattagcaagactaaaaaaaatattctttcctaacaacactttcactggaactgatgcgaagattgaaacctttaaaaaagtgctagacttttacaaaagtttgcatttgaaaattaagcctaaaaaaatggagggtttccaaatatcgttcaccgattattggggtaaagcaatcgttcaaagactaaaaaaaaatttcgatgacgatcccaaccattccttttcgttttcgaagcttgtaaactcgtctaaaaaatttaaggaatgcagtgtgccgatcccaatattcgttgcaaattgcaaaaatggacttctttcaaacgttatatttgaatttacgccctttgaatttggatcttgggaaaatatcctcagacttttcgtcaagttgccctatttgggctcaaaaattgtttctggaaaggccgagaagtgtattaataactttgatgatctaggttttattactgcgacgtcttcttcaatattcaacaatgtgctcatcttcatctggaatttggcttctcagtcctccagagaagcaatgaaagctttgaatatggttatgggaatttttggcctaggtaaagaggaaatatttagtatttcgaaagactcctcgagattagagacagactatgccgtatatcaacccaatcccttttatctttatcctgaaaaagacaatgtcctaactaacaaaaatcatttataccttgtagacggcggagaagacggcgagaatattccactcagaacattggtgattcctgaaagggaactagatgtaatttttgttctggattctagttcggatattgacaactatccaaacggctccaagttaaaaaggatattcgaaaaattagatgaagagaacgttcattaccaatttccgaacaatgtaaaaacattcactcaccccattgttataggatgcaatgctaccaaaagaactggacatgattcatttttgccaattataatttatcatgccaatgcgaatcatggaaacgcatctaatacgtcgacattcaaaataacttacaatcagtctgaagttagcagtatgttacccactggaaggggagtgtttagcaatgattatgacctttattataaaaattgcttaggctgtatattaaccaaaagaacaatggacaggctcccaagaaaaaagaaattttcgccattttgcttacaatgctttaaagactactgttactcataagagagtagactttttctgtgaaatttaatgagtttttgttcaccttttttacttttcttctatgccatatggttaaataaaacatggttcaaacgcgattcttttttattatctatgtctttattatgtagtcttcactataataaccgttaatgagcgacatagttgcatcagtttttaaggccaatttgattcagaaccttttcaagttcttcactttccatcttatccgaagacgcgatctggtggcatctaatactatgcttctcgaatatcgtttcatcaatttcaatttcaccattttttaggtaaacaatatcagtaataaaatcttgccattcaaagtcatcattctctgaatggacacccttagattgcctatagcctgctattgccctactcatagaatctatgatcatttgaacgtagtgtaaaccgtctaaaccaaaaacctctctatcatatttattatttatgagcaaaacttttttcgtattattagattccaaaattacttcagcaagattaccaagaataaggattgggagtaaacttgtcattaaagaaccgatagaataaacgaccatgtcagcttttttcaccttggaaatagctcttggatttcccattggttttatctcttcgccatatgggtttatatacaatatcctatgtaccggagcaggtagattctgtgattcatcaagcttgtcaaaatgcaactgggagtttttcagttctggaagaatatagataggattggcatactcctcttccgcttcttcttcctcatcgtcgaggagaattttcaaatggtcgtcataagagccaagtaaatgaataaatttagctgaatgtgctatgctattatctttaggaacagatttcgagggatgcgatatttgtgattggccagttatcatctcaccattcgtcaacaaagccgagatatgatgtgtgtgattggtatttatacatggaataacatgaactagaggactgcaccttcctatcctcatcattagttcaatagatgcgtctagagaacctaaaaacaatctagcaccagttaagaaaaaatttccaatggatgcactctcaaactgaaatggattcgagtgtttgatttttttcaagagttctgcttgcatatggataataaaagaacgacacatttccttaacttctatcgaaatatttttccatatgggatgcgaaccttccactatttcattccattctttcttagctaataacttatcattaggtagcctatggccaaacaactcgacaagctgttcatcttgaagtagtctcactattctagatctgatatcaccaattgctgggccaccaactattcgtagaatttcacttgtggacccgccattatctgatattggcaatatatacgtcagctcatgtccttttaagatagaaatattagaaaagcaaggagtcaatgaatttgtggcagtcccaccggagcacacaacgacgttcatctagtaaactatctcaccacactctgctattttgtccccttattacctcgagggaacaaaagattccgtttcctctctttcatagtccgcctaaatagcttaagaaataaacccaaacatcacacattagcgttctttaggaaatacgaaacaggttaatacaacagtagtaactttccacataatatctaagcattacacgctgaaaaaaactctttattggatatcaacaacccaacacattgtacgacatattcttttatcgttctactatggtaccctgttcaaatctctttttctaaaatgagcgaaattttcgaaaattatcgcataatttttcatcatcttaaattaaaaaaatacagtgtcctctattgtttatctcaacagaacgcacacattcttgaaacttgctcacataacataagctggagtgacatagcatttatatatatacaagggaaatggtcaaagctgttatttttaccgatttcgacggtaccgttactttggaagattctaacgattatctgaccgatactttaggtttcggtaaggaaaaaagattaaaggtcttcgaaggcgtgttagatgatactaagtcttttaggcaaggtttcatggaaatgctggaatccatccacacccctttccctgagtgtatcaagatcttagaaaagaaaattcgattggatcctggtttcaaggatacattcgaatgggctcaagaaaatgatgtccctgtcatcgttgtttccagcggaatgaaaccaattatcaaggttttattgaccagattagttggacaagagtctattcacaaaattgacattgtttccaatgaagtggaaatcgatgcacatgatcaatggaaaatcatctataaggatgaaagtcccttcggacatgacaaatccagaagtatcgatgcttataaaaagaaatttgaatctaccttgaaagcaggtgaacaaagacccgtttacttttactgtggtgacggtgtttctgatctaagtgctgcaaaagaatgtgatttgctatttgccaaaagaggtaaagatttggtcacttattgtaaaaaacaaaacgtcccattccatgaattcgataccttcaaagacatcttggctagcatgaaacaagttctggctggtgaaaagacagtcgctgaattgatggaaaattagtgcaagactcttacgaaatattaaagtttaataccgtgtaactgcctcttacatatgtatgcatatatacgtacgtactatatttttcttgtatatcttttttattgtctgagagaaagaacatcaaaaaataaaggaagatcctcctcggatttagcatgcttaatgccgaatctttaatacaaaacgaatgatatttcaagtatactaattagaaatcaatcaaacataccaaaagggacagtaaagagaaaagcaggagctctcttttaggggaaaagtaaaatgtgattagtatttcgttgcgtgtactagtcaactcttcttgtcattcttaaatttacattaattaccccaattttgcatcttcgtatataagagtgttccccttataagctttctcctgcacatacctgcagtaaacacaagcaacactttagagatagttgtccaagttaaaatgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataaaccaatccgccattcatttgaaaagacaagtctggcctagggttatagtgttcagacttgaggttgaacatatccaaaaaaaaaaattcctatgatgtcttaaatacgtatacctaataaaataattctagactatattcaacttactgtaacccttcacctcactatcacagctgacgcatgtagcaaatcctttataacccagagatatcctacaatcatcgcataatgcaaggcatctacagggccaagttacaatatttcttttattaactttgcagattaggcaggagagatccatttcctccacttcgtcgcaactatcaaaggcaaaatcaaacttgaactctaatttgtcatcgtccttcatatttaaacgtttgtacatatacctggagtttgtatgatgcagaaggcgttcaataacaacatcgactagtacaccttgtgggtttcttttaccatattgtgatctagtcaacggtccattaaccttattatggacatccatttcataatttaaaatagaccacatggagatgttccaggctatttcctctaaatcatcagaatcgacagcattacttgataaatgtgttaattctttttcttcatcaataatcaactgactttccatatcactatcaaactcttcatctgaaacactttcatcgatttttctggggggaaagtagtcttttgatgaatcgtcttcaggaagcaataactccaggcttctgagatcactctcaatattaagctctttgacgtccggtttatataaaaactttttatagtttttttctgtaacatatttgtttaaatccctctttttacgctttcccactctcggtttcttatctatactgctctcaaaatttttactccacagaagattttttaggagtctagaatacgtcaaaataatggttcttactaattcaaaaaggcctaaatatgtcctcgcaaaacctggtaactgggaatcggtagtcatttccttacgagataacagatcctctggtgtcgactggagttggtttaaatgtccactaaccacataactattactgaaagcagcgacttcatcaacggattttacgttgtctgatttcttaaatattttatagtcattcgacgttaaaagtagacacaatgaaagagctatttcgttaaactcctcttctccattgtaattatttgatctccaccatttttccaagtttttatatcttgaatataatgatcggaacggattactggtgaacaaagccttcaggaaaatgcctatagacgccagtaatatggtggaaatatagaaaaagccagggaaataattgtgaatgagacagatgttaataaaatctaatccgttcaaataggtcctagtgacgaatgcggtaaaaaaacccgcgtttaatataacttctccacataatctataggctcttatatgaaacaattctaccaaatgaattactaatctgtgaaaaaccgctcctagtagttcaacattatcgccaatatgctgctgccccgcgggcattttggatatgatataaagattcaatgataaaccccatatggaaaaatcagagcatattaatgaaggaacgttcgtcgttgaagaaataaaaatttcaatgcagtcagacagagctacaaataaatagacacttaaagcataaaaatctgtatcactcacgtgcagttcatgcatgagtccaaattgactcagaatttgtaaaagtgctttaaccagtgaaagagtggctactaaatggagcaaagtttttgaccaaagaggtaaacgaatgtttgtagaatttgatctcaatgaagacattacagtcaacctattcaaaataatggcggtactaaaacatagaacagcatacttacttaccgaataggagaaaaacattctaattcctaccttagctagttgcaaagtggtgaagttacctttctccatcaatgcttgaaaagagtccaaagttggggctgaaactattgtagaatttggacttacaaaaacttccggtttctgagttgtgttatctaggtaattaagatttccagtcttgttgtgaaaaaagctaaatacatctctgttatggagcaattgcttaacatgttgcaatatatttgtagacatcagtcaaacttttgaaaatccctacgtaatgactgttcctgacaaattgtagcctctcggtgaccttctgtcaagtcaaccattccttacatacatcatttatatgccagagggcagggtaatgcagacatacaaaaactttaatttaccgcgcaccgcaccgcgcaatttaagattattgagtcaaaattaatgatgtatattatatgatttctgtggtgataaatttatttgagtttataattatatttgcttaggattactattaaaaattttcatctatagcacgtttttgagcgtcgtttagtgatattggatagtccactttatattttacaatcaaattacctctctgagatgggttctttggagttggcataccttgaccaggataagtagaagtttgtgagggttggacaggctgtactctcgacaaaggtaaggttctgccatcaattgtttggatagtttttgaaaaacctaacaatgattccttgaaagatagtggcagagtgtaaattaggtcatcaccgtctcttttaaagtttggatggctcttttcctggatgacaaactgcaaagtctttctacggcccgtttgaggattgtaatcaccctggttcttgtatgttattttggtaccagctttccaacccggttttaattgaatgtcaatttgtgtcttttcagaggccccatgtgggccctttcttccaattttaaatgacttctttttaccaacaaacaaatcttctagactaactggtaaattaacttgaactgtttcttcctctggatacgtgggagagcttgatgctgatctaaagccgccaggcatacctcccatgccgccatgcattcctcccattcctccaggcatacctcccataccagcaccgccgccagatggataactagagaaactgaagccactgtcatcagcaccaccgaatggggaactgccgccaaagaattgtgaaaaaatattgaaagcatcctcattactgaacgcatgtcctccggagaatccgcccgcaccgccagggaagcctccagcacctccagcaccgccaggaccaccaggaccaaagcttggaccaccagatctagcagcctcgagaccgtattgatcatatatttcccttttttgaggatcatttaaaatttcaaaggcctctgatatctccttaaacttttctgtgtcacctgttggcttatctggatgatattttagagctgcttttctataaccctttttcagttcttgctcattagcacttggagatactccaagtaaatcataaagttttgtctccttgaccattattagttctgtatactatactctattatattgatgtgaatgtattaaaaaaaaaatcttaaaatgcaaacaacttatcctttatcctctgaagagtttctggatggttatacaattctaagtcgttaaaagaattcgtgtaagagcttaaataatattaattagaatttttgacaagaaagcgcataagtttaaaaagggattaacaatacggtaaagggacgagaaatctatacaatatatattaaatctcgaactaccttggcaaggagtttgtgctgacagtggttgaaaaacccgtaaaaggatatcccattctttttccagaagtttctggaacgttcatataaaccaaagagggtaacacaatacgttaagattcagaaaagtaacgactagctattactgatcatgttatagaagagtgcgacaaccatatattattagcgcagcgatcaacgtggcagtcttgtcatccatataaaaaaggagttctgattgatgtctgttatcttagtatctgctggctatgaccacacaataagattttgggaggctcttactggggtttgttcaagaacaattcagcattccgactcacaggttaatcgcttagaaatcaccaacgataaaaagttgttggcaacagcaggccatcaaaacgtacggctttatgacattcggacgacaaatcccaatccagtagcatcctttgagggtcatcggggaaacgttacctccgtttcttttcaacaggacaacagatggatggtgacctctagcgaagatgggaccattaaagtttgggatgtgcgttctccgtccattcctagaaattacaaacataacgcaccagtaaatgaagtcgtaattcatcctaaccaaggcgagttgatatcttgtgatagagatggtaatataagaatttgggacttaggagaaaatcagtgtacccatcaattgacacctgaggacgatacctctctccagtctttatctatggcaagtgatggttcgatgttagcggcagcaaatactaaaggtaattgttacgtatgggaaatgccaaatcatactgacgcatcccatctaaaaccggtaacaaaattcagagcgcactccacatatataactagaattctactatcatctgatgtaaaacatttggcaacatgttcagcggatcacactgctcgtgtgtggtcgattgatgatgattttaagctagaaacgacattggatggccaccaaaggtgggtttgggattgcgcatttagtgctgacagtgcgtatctagtaacggcatcgtccgatcattacgtgagattatgggatttatcaactagagaaattgtcagacagtacggtggacaccacaagggagctgtatgtgtcgcattaaacgatgtatagtttacaatttatcaactaccaagcttgaaggaccgaagtgacaaaaaacattatgattttcagtgtttgcttatccgcctttttgtaaatatagattttactatcctgtgcattttagttaattgattgttcacaaaatgaaagcaatcgcgatgcatatcatcaatgaaaggaagacgagaatgtacagtataaacatattcccttgcatgtagcactaaattttaagtttcgtgtagacgaaaggtttagctacttgcgcgacaaaatagtaatatttacaggcattcttaaacattttatatgtgtacatactgtgcgtaaggaaagaaaatcaaagcttgctcaaaaaagcccgcctacttctagcaatgacttcaactttatttttggtgtaatcaaaacgtctagacacaattgacttcttcccgcttttggtttcaaccgtactatctgtttcggggaagaccgactttaagtatttcctacgcaaatgtacttcttcagataaagtcaaaaaattacaagcgtccttgaaaagcgccttaatataattcttgtcttttttggtttctaagtgttgggatttttctaggtcctctaatagttttgccttcaaagcttgtttttcttgttccgaaatatactggtgtagctctagcttgttattgaaagatgtagatgagttcaaaagatcactacactcatcaatcttggatagactctccgacaatttctcattcgtccagctttctctccttgccttcaaacgctcttcttcttttaaataatatctactattgaaccttgcatcttctatggggtatccattcttcagggaagcccttacacgaattaagtatgacgttgccaattcgatgtcttttatatctaacttaagttcatcccgaagaaccttactcaacttgtcttgtaactcctttcttttagattccctgacctctaactgcttcaaaatattaggttttgcgagatagtcttttctagaaatagaattttcttccttatatgctgcccttttatttgttaactcaaaacggccaaacctccttacggtaggctcaaaatgaggagatggcagtttcaaatcacgcctcaaggcaacaccaatgaattttcttttaggatgaaaaggatcaagatagtaacgaacaacaccaggttctaaggcgaatatggaatgatctttccctataccaacgttttctccaggataaaactttgttcctctttgcctcataataatttcacctgtggaaacatcctggccttcatatttttttggtcctaaccttcttcctgcagaatccttcatacttgttctcgagcccgcagcccttttggtggcattacgcacttgaaggaacacaccagacacatgtttttggaatgaaaaactagaagtatctagtaaaataggattccacatattctcaccttaggttaagcttgaaatattatgaccacccaaactggcgagttttatttttacaatgagccaacttcattcttcagtgaactatcttgaatgagtctccaaagaaagagctttaaaattcaatagcggaacgtcagatatcgaaacacccagtcataacagccaaatttgcataattggtataaaaacagtgtgtataacattacagagaagccgttgtgtgaaaatctttttagtacctattcaaccaaacaattgaacttgaacaccaaactctagccatccttatcctcttctggtcactacatatacctcaatttacgtctttccttgggtcgtttcaaatgactctctttgtttagcgagggaaatgaaaaagtagagtactggctgaaaaatttcataattatgtttgctcatgagttcgaaaacagtttgaatgagcagatagaacgccaaatattaagttaacaggatatgtctgatcaagaacgaggttcagaaaacgtatgtttcattgataagggaggtgaagaaaagtttgtaaaatgagactttatgaggtcattggaattaaatagacatcaacgaatggtgagtcaccatttaatgctgccttcaaaacgcttgcttcaatgtgattccactggttaaagggggttttttgaatgcattgctaatgtttatctactggctatgaaagtgagaatatcaattataaataaaaccctgattttctacctgccatgctataatgtacagtttattccaactttgaaacgcaatgacttattggtctctctcattatgaaatttagttacttttactaatgttattcattgttgtagaataatcgaagtagatcgaggtcgagatcacctgttcgtcgtcggatgagtgatgatcatggttatgaaagagacaaccatttgtcccggaggtcaggtaattataacggtaggcgtaagttcgcagatacgtacagaggaagcagagatagaggagaatatagaggaggtagagaaaggtctgattacagagaaagagaaaggttcaataacagagataatcctagatctagagaccgttacgatgataggcgcagaggaagagatgtgactggtcgttatgggaacagacgtgatgactatcctagaagctttaggagtagacacaatacacgtgatgacagtaggagaggcggttttggtagtagtggagcaagaggtgattacggtcctttgttggcacgtgaattggatagtacatacgaagaaaaggtcaatagaaactattccaatagtatattcgtgggtaatttaacatatgacagcacccccgaagatctcactgagtttttttcacagataggaaaagtagtccgcgcggatataattacatcaagagggcaccacagaggtatgggtacagtagagttcactaattcggatgatgttgacagggccatccgccagtacgatggggccttcttcatggatcgtaaaatcttcgtcaggcaagataatccaccaccgtcaaacaatatcaaggaaaggaaagcactcgatagaggagagcttagacataaccgaaaaacacatgaagttattgtaaaaaatttacctgcttccgttaattggcaggctttgaaagacatattcaaggaatgtgggaatgtcgcacacgctgatgtggaattggatggcgatggagtatccactggatctggtacggtgtccttttatgatattaaagatctgcatagagcgattgagaaatacaacggttatagtatagagggtaacgtcttggatgtcaagtctaaggaaagcgtacataaccacagtgatggagacgatgttgatatcccaatggatgattctcccgttaacgaagaagctcgaaaatttaccgaaaacgttgtcggtggaggtgaaagaaatagactcatatattgcagtaatttgccattttcaactgcaaaaagtgatctttacgaccttttcgagacaatcggaaaggttaacaatgctgaattaaggtatgattccaaaggggcaccaactggaatagctgtcgttgaatacgataacgtcgatgatgcagatgtttgtattgaaagattgaataattataactatgggggttgtgatttggatatatcgtacgctaaacgcctctagaactactctcgatctatatactttctcacctattggatctgcgacaagtatttattcattcttgacttatttccaggctttttaactttataatgtcattgtgtatacgtataatctgaaaaaatttcgaagactttgaagaagactgtgaaaagagtctgatttttccaatacagtgaaaatgggtttaacaaatatccaaaaaagtactttgaacagatatcgtaaatagacgacttttttatatgaataacaaaaaataaacaacagacaagaggcctcagaaggcttacgtaaagtacgtaaacgatctacctcttacaactggtagttgcttttgctctatgttttcattacgctctcatttctccagccgttgggaaacttttcgataataacgaatgaacagtttcatacatgcctaggaagatagcaccacctgcactgatccacattgtccggggccccactccactgaaaaatacagcaggaccttcctctctgtaaatcctaataataacgcttccaagtgaggcggttgttttgttgagcattaatctggttttcaagaaatctaatggtgtcgttgtagctgctgcgatcccacccgcaatagaaccgcagatagcccctttccatggctccacttgactttggccattggcttttgcccaagtcttttttagatactcgtataaaggaaactgtatacaagtaaacggtatttctctcataatggtggtagaccaccctctataaagatttttccttaaaccttccttattgtcatttcgtagaattgactgtaaagtctgccaggaagaattggtagagtgaacttgcgtcctttgcttaacgacttctgcgggaactcgaacaagacaagcacaaatttcaccaatggaagaggaaagcatgtgcgttgtcgtatcaatcaattgctcagatccctgtgagtaaagtttgctgatatatggccttgattttactttcatataatcataactaataaagaaaagtgaagcacctggcgccgatgctacaacagcgcttcccaaaccacgatatatgcctttgtatcctccattagcaaagaatccacccttagcttgaagcctggttttaattgtgtctatagggaaaaaaaccaaatccgtagaggtaccagcagcggcgccacttagcaaggaaagaaaaaaagtattcatagcaaacttttcaaagcgaattttagttcatcggtgtgtctaaacatataaaatcgccaaacaatttacaacaagtggagctttaatgatctcatatattctcgagggtgcaccccactgcaaatgtatttatatacaaaacagcgctcagtaagcgaggaaaaaaagaggcgcccgtgcttttgccgatacataaactaaaaaccaataaacttgccaaaatacgtatattcttcaatccatgaggcaccactaattatatgcaaaagctcaatatctgctccttcaatggcattagataactaacaacctatgtactatacaattttaaaatactctcttaattaattcaacttggctaataaagagtcaatgtcaacttcgataactggtgctgtagctgcatttgaaaattgacgagttcttgattcagcctcccgctgttttattttccttagcctattcaaagaaccaaatccagatacttctctattcaacttgaatggttgtaagaagaagttacaaacagaaaaagactcacccatagtggcaatctcatgaataatatcttcaacacaaattattccatgatctcctaattgctcctcgacaatattgttgtcattaagaactatttcgtgaggttcagcctcattctcacccttatagattattctacctctcttttgaatcaaggaacggatagaagataaagaaggcttgccaatcactacgtatggcgcaataaccttgagcaacggatatacgtttttggtcaatttgacgaaaacaccagtattagtttcaactaatcttagcaaagacaaaatcttaaatgctttgtttggaatatttacagcaagcggacctcttactctgacaatgaaaagtaaagcaggtttgccatcgtaagtagtcttttctctgattaaaccatcgtcttcttcttcttcagtctcctccaagtcgacagagttctcttcggcgccattagctttttctgttattttcagaataaaatctttcccagatgcaatatgctgcgtttcattctttgccttcttatcttctaatatagacactcttttaattctttccttttccctagaggtagccaaagtctttgcaactatactttcagctctgacaaatttgttcttattacttctcttttttttgatttgttcttccctctttttcttagctaattcttgtctttcgattctagttctatcagcatttcttcttttcctcaaaagaatttctggattagaattaagagtttgcgctttactgtcttgagttgaagacattgtgacttgtatatcttattctttttccctgtggcagcctcttctttctaggaacttaataacgaaagtaccaaacaacttagacttttctcatctcatcgcttcccagctttttttaagcagagctgaaaaaaattttctttttaccaaaaatccgtactgcgtgatgaaagtgtacatacattattcaatattcacctagttttgtatattaatgtaaaatgtaatttaatgaagatcccaaaaaattaagcattcgttgctgcatcgttgtcattttgttcaattatcgcattcctatcatagcaaaaatatgaaggttattagtctgaaaaaggattcttttaacaaaggaggagcagtgattactcttttaccggaggacaaggaagatctgtttactgtttatcaaatagtagacaaagatgacgagttgatattcaagaaaaaattcacctctaaacttgatgaagctggtaagaaaaaaagtacagatttggtcaagttgaagattaaagtaatatccgaggattttgatatgaaggatgaatatttgaaatataaaggtgttactgttacagatgaaagtggagctagtaatgttgacatacctgtcggcaaatatttgagctttacccttgactacgtgtatccctttactatcataaaacaaaactttaataaattcatgcaaaagctcttaaatgaagcctgtaatatcgagtataaatcagacaccgcggcggtcgttttacaggaagggatcgcccatgtttgtttagtgacatcctcctctactattttaaaacaaaaaattgaatatagtatgccaaaaaagaaaaggactactgatgtactgaagtttgatgaaaaaactgagaaattttataaagcaatttacagtgcaatgaagaaagatttgaattttgataaattaaagactattattctttgctctccaggtttctacgctaagatattaatggacaaaattttccagtatgccgaagaggaacacaataagaaaatactcgataacaaaggaatgttctttatagcccactgctccacgggctacttacagggcattaatgaagttttgaaaaatccactatatgcttcaaagctgcaagatactaaatactccaaagaaatcatggtgatggatgaatttttgttgcatttaaacaaggatgatgataaagcttggtatggtgaaaaagaggtagttaaagcggctgagtatggcgcaattagttatttactgttaacagataaagttttgcattcagacaatattgcacaaagagaggaatatttgaaactgatggactccgtagagagcaatggaggaaaagcattggtattaagtactttgcattctcttggagaagaacttgatcaattgacgggtatagcctgtattctaaaatacccgctccccgatcttgatgaagacgatggtgaggagtagatttactatgtaagaaaaaagtaatgtacacataaaatttgcaaccctataataaatcggattattctctttacttcttccctataagcaagtagatgtgaagccgcaattaattgagttgttgtgaaatggttctagttagtcacgtgcagctttttaaaaatattttaaaacattttaaaaaatatacatttttttattatttttttatatattaatgttaaaatttatttatgtatttgtcttccgaaaagtaaaataacgttcaaatttggtatttaaggatatctgcgtttaggcgcctagcaaaaaaatgccgaactaagaaattatattaatgtggtataagttactgtttactaaaagtgccccaaacggcgctggactgataagaatgaatacggattagacagcaggtttatgctaccctgctcctagttttatgtgattaaactcaaaaccttgctggtagaaatataaaacactgcttttaattagtataaaagtgacatttatcttgaggtaagaacagaagaaaaaaaggaaaaagagaaaattttatgagattgcttttttcacatgaccatattatattcgctttatcaactttttagtgtatcttctactctaggacagataaagatgcattaaccttgtcattttgcttcttctgcaggttcatatacatataaacgttagttacaccttgacgtagtatatcgactacaggctagattttactgctaaatcagcgcgccagcccaccacaattcgatttgaaagcgctttgcaggaatttaagagcattttgttttctattcattgatatcatttgccaagtatataacataaccggtaggcataggggactcaaagcgtaaaaatcatgaagtcatagccatttccttatgtaatatatatttatataaattataaactactcattcgtatatgaaaatacgtgtttgaatagtcgcataccctgaatcaaaaatcaaattttccttagttcttactttcgattttctttaccaactccttgtatttttcggtggagaatgattttggcctttcgattggagcaccaacagccctatcgatgattaattggggtaacacaccaatagctctggcaacaccaaacaatacagtgtagaacgaagcctcagttagaccatagtattgcaataaaacaccggaatgtgaatcaacatttggccatgggttcttagttttaccatgcttagttaaaacccctggggcaacttcataaatggtggagaccaacttaaataactcgtaatctgggaaatgtttcaatgcgaattcacgttgagccgtataacgaggatcagtttttctcaaaaccgcatggccataaccaggaacaactctccctgcgttcaaagtatcccacaagtacttttcaattgtttcttttgaatagtcacctttcacttcttctctcaatttaaatagccattctaaaacttcttgattggcacgaccatgtaatgggccagctaaaccattcaaaccagcggccaaagataagtatggcgaagataaggcagaacccactaaatgtgtagtatgggcagaaacgttaccaccttcatgatcagaatgaatagttaaatatagtctcattaagtcaataaaatccttgttttcgtagcccaaaagttgggccaaatttttaccatagtcagcattaggatcggttgaagtaattttaccatccttgaacacattacgataaattttggaagcaataacaggtaatttacccagcagatctaacgaatcttcaaatgtatagctccaatattctttcttggatacaccttgagcatatgctttggcaaacttagactcgctttctaaagcagtcacggcaatagaaaattgcgccattggatgtagatcttttgggaggctatctaaaagttggataacgtgctctggaatttctgatctggcagctaaatcagcagaaagggctttaacttgagcgtcagtaggtatttcaccagtcaaaagcaaccaaaataaagcttctggcaaaggttctgtactaccctcagcctttggtagttccctttgaatttctggaatagtacgacccctaaatctaataccttcttcggggtctaacacggaaccttcccaaacaaggcctttaatacctctcataccaccataagcttgctccaaaagaacttcaccaataacggttttaccgtgttctttcttgaattttttaatttcttctgcctttgctgggataatttcagcaaatctctccttcaacgtttgttcggaggcgctactatagtggcgagcattcaatagtgcaaaaagagccttttgcatattttgacattgtcttgtggagccccttgataagaaacttttgctagttgttgataatatcgctgacatcttcgtaaatagtattatattgctatatgttttgccttattttctttttaatggttgtaattgtaattacttaaatgcaaataaaagccaaaacaaacctggtttgtattttagtaaacagcaaatttcccccttaagactagcaatccataacaggggaagggtaaagaatagttgctgcaagttttgagcatttatataatggatggatatcaattgacattttcaaacaacaagaggtcggataagtcgatagtatcggaaaagctccaaagggattgcgatcctccaataacacaaaagtatttttggtctagcgggggtcatacttttcatttccgggcggctgcggcggaaaaaaacgtgacgccttttagcacaaaaatgcaaggtaaatacataaaaaaaaaaggcaatgtgaacgtaaaaacgctcatatttacaaagattaattgagccgttcaatgaaatgcgaacttcggagatttctttaattagtttaggtatactttcctgcgaaggtcttgttggaatatgtagtaatctctacccgcgtttttagttaatgctgaatggtttttgatggctccttttttcttagagtgacaggcgcggcagccccttaacgcgggtacctgaacaagtaaatccgaaaattcaatttgacaagggaatcattgggctgacaacaataagatgagctctcttatatttttgcccagggaaaaattttttgcccactaaagatatgcaatattaaaaaatttgataaaaataaatcaatgggggcgagccgggactcgaacccgggacctcccgcaccctaagcgagaatcatacctctagaccacacgcccggtagaagttgttttaatgaatttcaaaatatggtacctcaacatcaatagatcatcaaccacaacgtaaaacatgcatgtgaggcttaggtgatttttgagataattgttgggattccattgttgaaaaaggctataatattaggtatacagaatatactagaagttctcctcgaggatctaggaatcctcatattcctctgttgataattagaggttaaaaattagtattaatgaagaaataagtactgatcttcttatactaaataagagatgtatataaaacacacgctgattggtcatattaatcatgaccaatataatagtgattccggtagttactaaacattgatgtgacgactcatattcctcatatatgtacctaccataacatgttcaactaataggtctttaacacagcttcagtattgtctgagcttctcgtttaacattccttctgcaataggcgcaatcacacttaaacgtatacgaggtgtacattaatatacgatgtaagcattagattgttaccatagcaactcatgtcactattaattactctcgttccaacaaaacaattcttaaaaattcaccaatttagcttcatggcaaggcttacagatgattaaaatcgtgtagatcatggaaatcgaacctttcacgttctgcagaatttaaagtgactccatggccaagttggttaaggcgtgcgactgttaatcgcaagatcgtgagttcaaccctcactggggtcgttttttttcttatttcagatagtcttgtcggtagcaaacagtcaaatcgctatcacttacatgtgatatcatttctgtactgcttatgcactatgaagtgcggtttcttttttatgcgatattacatgtgtcaatagcaaaaggggtaaaccgtgctcctatacaacaagaacaatagttcggaaatgcatgagaacagtgttgttttataaaggattctatgtgaaataaaacaaaggccgatttgttcgacatttgctgggcttttcataaataatggatcataagaatatataataggggtaaaagttattttagcctgcacttttgtgtttttagaagaacaccttatcattgctaggtaatgcgaatggatggaccataatgtacgagttttgtcttgtggcaatacctgcgtaagcgttgtaccaggcaatgaaggctactatcacaccaaggaccccaccagctctagtgacgccaacttcgcctgtgaagtttgcaatggatagaagtaagaaggtcactgctaagaggaagaataaggcaaaaaacattatagttgatttcatggtgcagacggaaagaccgaaggtgaagagtgcccatcctaggaggtaaaaccctagcgcatttccaaggtcggattccttgtccttataggcatctagaattccaaaccaagggatgtatatagcaccgaagcttaaccaaaaaccgccgaaggaacacagggctgtaccaccgaaagtgttctctaaagcgatttcccaaataccagcaatgagttgaacgaggccaccgtaaaacatggcacacccaacaacaacattagggatagtgatgccttgggctcttgcattgaacatggataggacaaacgtagtgagggcaaaaccggaaagtcctagtggagcaggatttgcgaatttatggactggcgcgggggctaaaccgggattcagagtaccaccgaatgcctcgaacaaatcatcccttaaaaatttttgacggccgatgtaaatatactcgttgtttttgcccgcagtatatattttgcatatggactcttgcgagtggcggctctgatcgttgttttcagagatgaactcaccctcggaagaatcgagtgccttagggttctcaaaagcggtgttgccgctgctttgttctctgtcagacatgccttttatttttttctgtgattgaagattgtttttgattgatctgtagaatgttacatagttagttatggctattctagctctaggtaggacagttctcctgctttatatattttgcttgttcaaagatgatcacggctgttctcggagtgcgtaactgcttgagagttaaatccgtcgaagttgctgatcatttccagaaatgaggagactgttgatgatctactgtgaaattattgcggggctggtagcatctactgtcactattattgccatgtcggctggtatcggagttctccctccgccgatttaggatggagccgttccagccgcgtccgctcttaagcgtccgtaattggtcaacaaagcatttcagccgtggtgattggaaggaaggtcagctttcctgtattgcgtctctatctacttacaatacgaatgatacattgaattacgtactagtgtgagataggggtagtcaagaacttcaaattgtccattcatcgaaatagaccacttccttgtcgtgttttgaagccggaaacatcttgaagtagttaaagatggaaaattcttcttcatcctccaaagccttattacctgcctccggctcgccctcaccttggttcatttgtagaatgctctctaaggtcactctatagcagtcatgcgtgactttttccagcttgtcgtcgtacactaagacttcacacaaagatctgatatttgaaggggttaactcgacattggccacttgtgccgctgtaataaattccaaaatttcttgtgtggtagagtaattttttacgtttggagcataaaagacgttttttttgggtccattttcgaaattcttgaagccattagggaaggtgttctctgatatgaacctccaaacaatagtcaataaactattgataaattctatatccagctctccatctgtgaaccatggacctcctgtgatgtccacagagggttgtaagctgtacaacatgtagattttccttgtgggaaactttacactcttaacactcttcacgtatctttgggattctaaactcttcaagcatttaagaactacatgctgatggagattggttcttgccttgatagtcttggaccatatcccttctctaccgctagcctcgatataagaatataccagtgcctcttcagccgacatggtggctttcttttgcgcctcagattctaagacaccttgaaattttaattcgtcgttttgttttactaatttgatcaagttcttgtctagcaattcctgtacaatggacatcaagtctgttaacgacccgattcccatttgtttttggagttcttgctgtgtaaataatgcgcctattcctttcgacatcatctggctatgtaaggttttagcattgtccgatagctgtaacccattttctatcattccactcatattcaggatattggcgctgtaaattcttcacttgattaagattttctgtaatgatctcatctcacaaatacatcgcaaatcaacttgaaaatttttaatacaataaaagatttgaaggaaaaaaaaagtgcctgtgcgcgatgttacttaaaaacaaaaagattaaataattgcaatatcatctagttggattctaaatatactaccaaacaagggcttaaacattttaataaacgatttacatatttactgtgggtatggcaatgggtgagcgtaggtatgctacggtaggcgatgtagtgagtagtgcggacgaaccgtagccgtaacgtttaatgccccctgccttttcttctcaattgctcacatgtaagcaaagtcttccaagaatctggttttactcgtagccttttaacgctgttttttttttttgcacacctttaaaacctatagaaactccttcatataaaatgtactagttataagatgactttttatattcaaaattagaagaaaacttaactaaaattaaaaaaatagcggctattaaaaggtattaaaaagtgannnnnnnnnnnnnnnnnnnnnnnnnnnnnnnnnnnnnnnnnnagaaaaaaattataaacttgagaaatcaaaggagactaaatgcataagcaaagagaagaggatctcctcggatgatagatttatacaattactctaacttagaaggtttactagacggattaacggacttgaatcgaattccgaaggaatactccgcagtattggagccatattttcagaatatagcaagaaatgcacatttaaagtctagagctctaaaaatttgtcgttctaatttccataaatggaacgaagaaggtgcgaagacagtcaatccggaaattataagaagatgccttaacctgtggtatgttttgaagggcaaggaatataaaaagttgaaggatcctccgcctgctgataatatcattaaggatgagattgatgtctcatatgttaagaatttgaatgtagtcaggttggaatttgacgaatttggtaaactcataagtaatccattagagaatttgatcttggaagaggtcgaagtgaatgatttcatacaagaataaacctaaagtgtgttcactcatctaatatgcacggagcctaccttttagcttttgctgccaaactaaaccaagattgaaagatatataatcgactatctttcgtctcgtaatctgtatcatgcaatttaaattaattatcaacataaaatgctctagttagcacgcgcatatccaggaaagttcaccagtaactatgtactagacaaaagcaaactgttcggagcgaccatacaccatatgttgttgaatcaacttttcttaaggctctttcgagttcatcattaaccaacctaggtattttcccgattttttggtaatatgtcaaaacagctactttgtatacatttatagacgcctggtgtcctttgagcctcacttatataaagtaaccttcacaagattttggattttggtaatacatacgctactgctatttcttgcggagcagcagaatcatcttgctcggcctccttttctgaaaatttcgatgatacctgaaataatcatcattagcagagggaatttaaaaatagagggtgtaaaattatcaagatttttttttgctaaggtgaatgagtagtgagtaaagaactaagaacagtatgtccgttagcacgccaagtgagttagacgcattaatagaacaagccactagtgagagcattcccaacggtgaccttgatctccccatagcgttggaaatttcagatgtgttaagatctagaagggtaaatcccaaagattctatgcgttgtataaagaaaaggattctcaatacggccgataatccaaatacccaattgtcttcctggaagcttaccaatatatgtgtaaaaaatggtggaacgccttttattaaggaaatttgttccagagagttcatggataccatggaacatgtcattttaagagaagatagcaacgaagaactttctgagctggtaaagaccatattatatgaactatacgtagccttcaaaaatgattcgcaacttaactatgtggcaaaagtttatgataaattaatctctcgtggcattaaattccctgaaaagctaacactttccaattctccgactgcaatgtttgactcgaagacgcccgcagattggattgattctgatgcttgtatgatttgctccaaaaagttttctctactaaataggaaacatcactgtcgttcctgtggtggagttttctgccaagaacactcatcaaatagtatacccttacctgatttgggtatatatgagccagtcagagtatgtgatagctgctttgaagattacgatttgaagagacatgacgacagtaaaaaatctaaaaaacatcgccataaaagaaagaaggacagggactactcaactcctgaggatgaagaagagctgataaggaaagcaatagaactctccttgaaagaatctagaaatagcgctagtagcgagcctattgtccccgttgtagaatcaaagaatgaggtgaagagacaagaaatagaagaagaagaagatcctgatttaaaagctgctattcaggaaagcttgagagaagctgaagaagcgaagctacgcagtgagcgtcaaaaagcctctagacagatgcaaccccaacagccatcacctcaacctcaacctatccattccgttgatttatctgatgaggagaaagacagcatatacatgtttgcttcacttgtcgaaaaaatgaaatcgaggcccttgaacgaaattttggaagactctaaattacaaaacttggctcaaagagtatttgcttccaaagcaaggttgaattatgctttaaatgataaagctcagaaatacaatactttgatagaaatgaacggcaagatttcggaaattatgaacatatacgatagattattggagcaacagctacaaagcatcaatttgtctcagcaatacacacttccacaagtcccttctgatccgtacaattacctaacagaaaatgtgcaaaatccagcagaaagctatcaaacacctcccctccagcaactatcatctcatcaatacaaaccacaacaggatgtctcacgccaacaatcggtaaaagcaaattcatcacctaccactaatattgatcacttgaaaaccatcgatgtgacaccacacgcacagcaaaagcctcaatcgcacgttgaacttgcaccttcggacccaccttatccaaaagaagaggccgaagatgaaggaacacaggcagtgcaagatgaggaatcctccacacaagaatcccgcgaaaggccgtatccagtagaaacagagaatggtgaaacttcaataaataaacggcctcaaggcattacacgttacgattttccaactgttcctgcacgcaaattcgtccaaccggagtcaactgtaccacttcctgcaagttcctctgaaattccgatcaaagaggaaaggccgcctagtcctcaagaggaactgctaatagagctttaatattgtagccttttctatgtatttgtaaaaagaaacctagcgcttataaatatatacatacatatatatataattgcttgttacgcaacttatacatatttctgtcattaaactagtttttaaggtgaatattcataatttatgtcagtattaacattgaaaccgtcaaaaaaaaaagtatcaatatagacaaaggaaggaccattttaagaaagtggttttaaggaagaaacttgttcctgcatatttatagttaattcctatcttcttgtttatcctgttttttgaccacctggcttgcagctaatagtgaaaaaacacaaatttttaccaaccttccatggtatagtcatgttgtatactcggtgtaacactagtaataaactttaagaaaacaatcaagtattggtctacccgtaacgaatcatcaatatcgtcttgtaaatcctcccagtctccgacaccgtccagctcttgttcttcctgcagctctttccttcttcgttgtctaaccacacgaaccttatctagcaatattttcattacattagcatgcttacatggatgaatggaaacagataacactgaattcttgtaaaaaggtagcttttcaatggtggctgtctttgttctataatctgctgatatatcttcgaacatctgctcagggcttagtggtgaaccattagaattaaaccccactatatacattttagggaccctataagatgtcgagtacgcaatataaaggtcgtaatacctttcttgcgccatatctttggctaggccacctttagcattaaattcttctgtatcgtcattttcatcctcctcttttatttccatgtcttgtattagctcatcaatatcatcgatagatgagtccttggtcccccccgcaggcgtactttgcacatgttcagtttcagatcctatgtattccagaacatcatcttcatctccatcttctgcaaaacctttcatgattacatctggcccttcaacttcgacacattgctcggcacgtttatcacagggaacttttctaattatcagaaactgcttattcttcggtaaaaaatctctgtaactaatatctgacgactcttcgttccacttccaggtgggaaacatatgacataaataatcacctgcttgtacaaactcctcaggagttatttgacctgtggttaaaaaggtagatttgtgcgttatgggggtaagatattctctccaactacttagtgtagatctaatcatgataataaaattgtatttactcctttgtacttctttgttcctaacttctagctagcttgatatacgtcaagtgtacgtaatcattcaagtatctactttcctttaaatagcccttcgctctgcttcccttataataataatgtccgtgtacaaaattgaatgcccaagaaggtgaaatttgaaaaataagaaatctactaaataccgatacgaagaagcgtatagtaacagccattacaaaaggttctctaccaacgaattcggcgacaatcgagtaaaaaatgggcacactgtttcgaagaaatgtccagaaccaaaagagtgattctgatgaaaacaataaagggggttctgttcataacaagcgagagagcagaaaccacattcatcatcaacagggattaggccataagagaagaaggggtattagtggcagtgcaaaaagaaatgagcgtggcaaagatttcgacaggaaaagagacgggaacggtagaaaacgttggagagattccagaagactgattttcattcttggtgcattcttaggtgtacttttgccgtttagctttggcgcttatcatgttcataatagcgatagcgacttgtttgacaactttgtaaattttgattcacttaaagtgtatttggatgattggaaagatgttctcccacaaggtataagttcgtttattgatgatattcaggctggtaactactccacatcttctttagatgatctcagtgaaaattttgccgttggtaaacaactcttacgtgattataatatcgaggccaaacatcctgttgtaatggttcctggtgtcatttctacgggaattgaaagctggggagttattggagacgatgagtgcgatagttctgcgcattttcgtaaacggctgtggggaagtttttacatgctgagaacaatggttatggataaagtttgttggttgaaacatgtaatgttagatcctgaaacaggtctggacccaccgaactttacgctacgtgcagcacagggcttcgaatcaactgattatttcatcgcagggtattggatttggaacaaagttttccaaaatctgggagtaattggctatgaacccaataaaatgacgagtgctgcgtatgattggaggcttgcatatttagatctagaaagacgcgataggtactttacgaagctaaaggaacaaatcgaactgtttcatcaattgagtggtgaaaaagtttgtttaattggacattctatgggttctcagattatcttttactttatgaaatgggtcgaggctgaaggccctctttacggtaatggtggtcgtggctgggttaacgaacacatagattcattcattaatgcagcagggacgcttctgggcgctccaaaggcagttccagctctaattagtggtgaaatgaaagataccattcaattaaatacgttagccatgtatggtttggaaaagttcttctcaagaattgagagagtaaaaatgttacaaacgtggggtggtataccatcaatgctaccaaagggagaagaggtcatttggggggatatgaagtcatcttcagaggatgcattgaataacaacactgacacatacggcaatttcattcgatttgaaaggaatacgagcgatgctttcaacaaaaatttgacaatgaaagacgccattaacatgacattatcgatatcacctgaatggctccaaagaagagtacatgagcagtactcgttcggctattccaagaatgaagaagagttaagaaaaaatgagctacaccacaagcactggtcgaatccaatggaagtaccacttccagaagctccccacatgaaaatctattgtatatacggggtgaacaacccaactgaaagggcatatgtatataaggaagaggatgactcctctgctctgaatttgaccatcgactacgaaagcaagcaacctgtattcctcaccgagggggacggaaccgttccgctcgtggcgcattcaatgtgtcacaaatgggcccagggtgcttcaccgtacaaccctgccggaattaacgttactattgtggaaatgaaacaccagccagatcgatttgatatacgtggtggagcaaaaagcgccgaacacgtagacatcctcggcagcgcggagttgaacgattacatcttgaaaattgcaagcggtaatggcgatctcgtcgagccacgccaattgtctaatttgagccagtgggtttctcagatgcccttcccaatgtaaatgaccgacattgactcactatccatccgtgtattatttcaaagagcgaaaagaaggcgcgtcgcgtcgacgcgcctttttaggctagaaaataaacagaaaacaaaaacaaaaacaaaaaaaggcgaaaaaacaaacgaaaaaacaaacgacagtagatagaggagaaggtttttgacaggtttgtgtaattggttatttgcttttatagattatatatacacaaacttaaaacactgttttctaagtaggctgcggagagggccaattgcagcagcgacgtacgcatagaggaaaaacaaccgttcatgtccattatgaagcagaggctaccactgggggagttttccagctcgaagatcaacaaactggcaattgccaatattgcagacgctagcgagcctagaaaccatggagaaaacaacgtcgggactgtgtgtcttccctctatcaagagtttgatggttagtcctgaagtatacgaaaacacgaagagtcttcctgttcccctaatgaggagcagtggcggaggtatggcttgtgccagtaagtcctcatgccaggatggtattagtacgaaaacaacgtctagagattactctgagctttccaagaagttgcaaattcgtttacagttcgcctattataaatacaagactaagcaaacagacaaaaatttcacagacttgaaatcaaagcatagcattacgaggccttccaaagtcgcgactcacagtaaatcagaacctttaactaggagaagaaaattagtactatctcagggtcattataaaacccctgctaggtctaagatcaaaactccatcttcgatttgctctcacgataatacatcttcctttacatctttccgcggtgtcagcgaaagctcgagcactaccgcagatatgaacgtcgcagataccaccacaccaatacgcaacaacataaacacaaagcattcaaacagtcataatcgcacattgtatcagagacaagaaacacctacaagcatcaaagccgctaagtctttaattcatctctttacaagtaaccaataatcccacccccaatatttctatctttcattttcattctccttcattgtgtatataataatattattgtcttcgtatatcttccacattaccttttcacttccgctttagttctgtacgtataattagatagaatatcatataaaacctgattttattagtatcgattgcaattctactgcggccattaactgtaaccgaattgaagaaaataaaagaaaaaaagagaacatgcataaatgggaaaaagaaggcgaagcataccagcatctaccagagagacacgagcactgaaagtcgccataaaatgaatctacagaacaacgttttaaatcagatacaccagattctgctgcctacgaatcctactctcgataaacctaatgctgaggctacaaaggaagaattttcgtctgcagaaaatagagatgaaaaagactatcttaccaaccagcagccgaaaaatctgagtactccctccaccagttccaacggtgaatttataccgcatattttttattcgctgcaccaaataaggaaggatccaaacaatctctcaaatcaattggaaaccttaacaggttcgattagacatcgtttgaaactttgtaaatctttgatatcggaaaacgaagataccaaggatttattaagtaaaagtccatcagaatggcaggatatcatccatcaacgtgaacaagaactgcaaattaagagagacgtcttggatgatctttatcgcaagttacaacgataaaatctatgctatctatctttagtctatatatatatatatatatacatacgcataccacatcttcaaacgtgcatatagaatggagcctgcgtttctagcaatacacatacacctgtcaaaaaaccttcaccgcctccccctatttgttttatcgtcaattaaatctttaaagatttgtggaaccatgtctatcaaccattcttccttagggataactagacagtccctgataaattccttcgacgttagcatcaattgttgataaagcacatatttgcttggtctctgcgccttttccttatgattaacgaaaagtatactggtaggatgaacactaacgttcagcccacctgatgacctacccatggtttgatagccggtggggcctaattgtacaatattcatcggaaacccgctgatgaagcatcgagttattctagcatttatgtagcccgctatattgcctatcttcatcctggcttggtcgttcttttcaactaatccaaccttttcactgcacctgaataattggtttctaatatttcttaccctcaacatcgttttgaattgaattttgtggtcttgacaccaacttctggaaaatttagagtttctccattggttgaagatttccaaatacaatatgtgatcactttccacttcgcttaacacacttgccgcagcatctcttttttgaccaataaataatgaaggtgtttcatgtagcatcgaaactatggtcaaacactcttctagtacaccttgacattgttcgtgcgtagcagctgtataaagcacttttgcaaattcaggttcacaaggaaactcgcacatcattttacctaaccgagtgattgtccctttgctatttaaggcacctaaaatgtataaattttccaaagacttccgtaatgtggggatactgggcttatccatcaggggaaactttattaggtcagtaacgccaagcgataataataataacaccgtattagaaagatttgttcttgtgatctcaggcttaggcataagttccaactcgtgcaaatatgaccatttggtaaaaattctaaaacattttcccggcccaacacgaccagccctaccggcacgctgatcaactgaagctcttgagcatggaactgttaaaagttgggtcattccagtggagggtacgtacgaattttccttaacaaatccaggatcaatgacatatctaataccatcaatggtcaatgaagtttccgcaatattagttgccaaaacaactttcctacaattttccggagtcggctggaaaattttcaattgctgctcttggggtaaatttgcgtatataggagttataatcatttgttttgttctagaacctaatttagacatgatctcctccagtttggtttttgttctttcaatttcttcttgccccgttaaaaacaccaatatatcccccggtaaactttgcgtagtatgaatttgaaaaatagttgttatagcggcatgtatatagtttgcctccggctgtaatgtgtagtggatatctacaggatatcttctcccaggaacgttgaaaatgggacaattatcaaaaaactctgaaaatttttttgcgttcattgttgctgatgatataagcaattttaaagtgggcctctgcggcaaaatatctttcagcaaacctatcaggatatctgtggctagagtacgttcatgagcttcatcaatcataatacaagaatatttgcttaatttggaatctgtaagaaattctcttagtaacataccatccgtcatatactttagaaccgttttatttggggttgttttgtcttcaaaacggatctgataacccacttccttcccaagcacaacattcatttcatctgctactcttgcagcaacagaagtggccgccacacgacgtggttgtgttatggcaatctgtaactttccctgatcagtgaatccatcttctaccaaatattggggtaactgtgtggttttaccagaaccggtttcacccattataatcaaaacttgattttttttgatctcttgtagtagctcatccttgtattgatgtacaggcaaaagttttcttgcctcttgtatagtcagtatacgcttttcctcagtttctaaagcttgtgctagacgtgcctcatattgaagtttctcttcaggtagtaaatcgtcctcctcattagtataatcaatcattgcatctgtgtcgaacacataatcgtacttgtcagagccttccaatgttatatcatcagggtgatcgctttgccccgccatagcatttcgcaattgttgttcttcccacatgcgttgtctgtttattttgtcaatttcttttgcattctttattttatgagtaacttctacgttaaatttagaattagaagaggcgtacttagtttcattctcggagtcacctagtagacccttctttgtagtaagttcattatttgacgttattttttcatcatactttgatgactttttttgtgatccaagttgttctccttttaaattgttcttttctggaccttggttcgtattagaaaaaactttattggggtcatagcgtgatcgttttagctgcaaggcagagttcttatccttggcctctttgtcttcttcctcacccaaggaagaaggctctattcttactgcattgtcattctgtcttgtaacttcatacgttcgtttcactcttcgcttaccggtttcagatgtaatacttgacatgtgttgctatacacgcttgttatctatatagatgccaattaaacatatagcagctatccgttattacttatacaattgattaatatcactttttaattgtccgggtaactaactgtcttccactttcagcacgttctcgtcatcaggttgtatgggctagtactgttttggctacatttgagatacgagcacttaaagaattcttgcatattttcgatgattagtctttaattttcccacttgttctcactatttcctctattgtcttaatacgctcacatatcgaagtttttttttcatgcgatgagcttcgagatgaaaaaaggaaactgaaaaatttagatcgataagataagagatgtgattttttttttttttcgtaaggctgtaggccttggataacgtcttatttactatttatatgcgacatcttcgataatttcatacgtttaatttcgaactcgcatttattttatttattatgtcccatcgtatagcaccttccaaagaacgatcttcatcatttatttcaattttagacgatgaaacaagagacacattgaaagctaatgcagtcatggatggtgaagtagatgtcaaaaaaacaaaaggaaaaagctctcggtatatcccaccatggacaactccatatataataggtataggtggtgcttcaggttcaggcaagacaagcgttgctgctaagattgtgtcgtcaattaatgttccctggacagtattaatatctttggataacttttacaatccattaggcccagaggacagagccagagcctttaaaaatgaatacgatttcgacgagccaaatgccatcaacttagatttggcatataagtgcattttgaacttaaaggagggcaaaaggacaaatatcccagtttatagcttcgtccaccacaatagagttcctgataaaaatatagtcatatacggggccagtgtggtagttatcgaagggatctacgccctttacgatcgccgattgctggatttgatggacttgaaaatttatgttgacgctgatttggatgtctgcttagcaagaagattgtcgagagatatagtttccagagggagagatttggatggttgtattcaacaatgggagaaatttgtgaaaccaaatgcggtaaagtttgtgaaaccaacaatgaagaatgcagatgctatcattccatcgatgagtgataatgctacagcggtaaatttaatcattaaccacatcaagtcaaaactggaactaaaatcaaatgaacacttaagagagctaatcaaattgggctcttctccttcacaagatgtgcttaatcgtaacataattcatgaattgccgcccaccaaccaagttctttcgctgcatactatgcttctaaataaaaatctaaattgcgcggactttgttttctactttgacaggttagcaacaattttgttatcatgggcacttgatgacattcctgtagcacatacgaacataattacacctggtgagcataccatggaaaacgttattgcctgtcaattcgatcaagttacagctgttaatattattcgatctggcgattgttttatgaagtctttgagaaagacgatccccaatatcacaattggtaaattgttgattcagtccgattcacaaactggggaacctcaactgcattgcgaatttttacccccaaatatagaaaagtttggcaaggttttcttaatggaaggtcaaatcataagtggtgcggccatgatcatggccatccaggtgcttttagatcatggtattgatttggaaaagattagcgtggtggtttatttggccactgaagttggtatccgacgtatattaaatgcatttgataacaaagtcaacatttttgctggtatgatcatctccagagaaaagttacaaaatcatcaatacaaatgggcattgaccagattttttgattcaaagtattttggttgtgattgagaataattagaggcaatataaagtaaaattaaataatagtgcacgtatacatactatattagtaacctttcattctctctatggataatcttaaaatcccattactttcaatatgccataacctactgtaacaatagcggcataacttaacaaactggctggtacacctctcgtaataaatgtacccacggtcaaatatctatcaccaacttcatcaatcattgaaatggcagtcacgttggggaaaccagaggttggaagacccatagcactagagcataatagggcggctataacgatcaatagtctagaatgatcacctgaaggtagattggaaccgatctcactcattaatggtacgatgatcattgccgcgacggtatgggagacaaaagtggccattacaagaatcactagaccgaagatcaacacaataatgaagattggttcatgctcaacctgcgccttaattaactgtgccattgtagacaataaaccggatgagcttaccgccttacctagggtggtacctcccatggccaaaacaacgattgtccacatgaaattattgaaatcatccgaagttagaagacctgtaccgaagaagactactataggtataatagatatgattcccatttcaccaaagataccggagatttggtttgaaagacaccaaagaacaattgttataatgcaaactaaagtgacaaaccattgcttcagagtgaatggatcacgggatggatgcaattgcaaaattttcacatttggctcaggagggaaggttatgatcaatagcacccaaattgccatgacacaaataaagcacacaggtagcgcaatcataaaccattcagcccaagatggtgaagggtccattataccaatagaaaaaatgttttgaggagaagcgatgggagaagacataccaccgatattggaggcaagagcgataccaagaattagagctttggcataggaacaatttcttggcagtgttctgagcaaaggttgaacaattgaatagcaaagaacgggggcagcaacattagaaacccacatggaaacaaagagcgccacaaacatatttgttaaaagaataaaatgtgggtttgtaccggcggatgccaaaatatgcgtagaaaggactttggcaatgttgtacttggaaagggcggctgctaaagtaaacccacccagcaaaagcatgatgacactcgaccacatcgttgataagatgaactgagaggaatcacggggagacattggttgggaggtgatagggtccttgataacagggaacactacaataagcagaggaatcattagagaagtcacgaaaagggggatggtctcagtggcccataataaagatgcatatattaagatggcgaaacagtttttctgtaaggaatcctgcgtaaaaggagtcaaattaaaagttaataatgcaatgaaacatgaggtgattaacagaaacttcagcagggaagtttggcccatgataaattgcaaccattgcttgggtggtaaatgcatgagttcacggaaagttagggaatccgttgatggagcgatgataccggcgccaccactcgacattgccatggattcagtaatgttggcattggggcgcaattgactggaactcaactttgaaaacttcttgttgtcagtcttggcagattggtactttctctccaaattcatcatatctttccaaacggtgtttctttcccaaactacgtgatctctcaaatgagaggataattcacgctcagcatcctggaaatcgaggacttcttgtctgttgccatcttcgtcttcttcattaccgctgctgttttcgtcattgttgattcggtcagcgtccaagttaaacgtattagatggtcgacgcgtgcccttgttcaagctagcgtaagtgaggatggtctcggtaatgtgatgctgaatcctatttattgtagcaggattgaaaacatgcgaatggaatttgatatagttcaagtagttctgcttcaagttcgtatttaaggacttgtcaaatttcttgcagatcttggagaacccggtctggttcaactcaataaagtccttcaactcggacaactgggtgtagatcgatatcaatcttttctttaaagagagcctatgttgggtaaaaggagaaagatacacagggttagagttagaaagcgacactgaagcggaggccaggttttgcattgagttaccattattagtcgtgttcgagacctgcgtgtggatgacgggtgcagagtcaatcgacatgtctgtcagagaggggttggagtccgtggaggagacactactaaaccttctttggcgttgttgtgacttagacttcctgtttcttgcaacactttgcagttgatgctgttgctgctgattaaacaattgggtggccttgttcgtgttttccagttccatgacatcgtccttcaattcgttgtagttggcgataagacctgtttcttgagatatgtagaatttatcaatttttttcaattcttggtttaaggcagcaacaaatttagagatgtagaattgatcatctggagaagcatctgccaatagcggcagattttcatcgttggcgtcatgtggctccacaacatggtgcttattgttactgtacagcttatctttttgcaaagaatagatcaattttttcagctgcgaataggccagatacttggtagaccattctggtacagaattgaattgtaaggaatgcgagaacttcatgtcagtctgcaagttaccgtgtcaccttcacagttttctttttatttgactaagtaaaaaaagaaaagaagttatttttactaagattttgagcggcatttttcctagttacttatcaattttcatacatgcaagacatactcaatttttttttttttttttcagttttaaaattagtcctgatcaaaaagccatcacgtggatccccgaaaaaaaacggatccgggtaaccagaagtatttttttcaagggaataaaagttaccctaccaaaataaaaaaattcaagtagggtaataaagttccaccccccatcaggattatcgttctctgacatcacccactctctgctcgctctctgctcgctctctgctttctttccccacgccggagtgattaaggcggataggcccacctgaacacctcgctcagaacatcagcgagagttccagcccctctaccccttacctctcgccgcccctcatttcggatcaaaagcaaaagaacaaagggccttcgcagaaacggaaggtttcgacccctcggtgccgttttaatttctttttctggccagttaagctttttgactttctcgaatcagcccagtgcaaaacagtacgcatacgagcacacaaatgtatatatatgtgtatgtatatatgtatataggtatgtgtgtgtacatccgaagcgtaaactaatgatctgcaagtttcagattttttctcgaaaaatataactaataaacgttccatgtcgtccacggatatcaagccttgtgccgtgaacatccctgtttccgctcacatcaccttccactacaagtcgatcgcggacagaagcagcagcaggagcagcagcagcagctcctgctcctctgctacatctaaagcctgctcccccagaggcagctccgtcggcttaccgcctgctttatcaactgacaatgaaatcgtcgagactgtacttaatgtttccgctcccgttgtagcagaccctacgcggccctcattgttcaagagtaactacaccgcagcctcgtgcttgacttctgacccaacctcgccgtcactactgccctcttctaggcgcaactctgtattgccggcaagcgacttccaccaatgcgcgcatcacaaaaactttcaaagaagggccagtgagccacaactgccctccttcgataatcgctcgtcgtccgagatgaaaaggtccgtctcgtacgcccagcatagcatgatgttccccatcagtgaccaacaggagccgcaaacatccgcgtctcctaacgaccactcagacccgtcttgtccttgcaacagacatcaccacagaagaaactcggtcgccgtcaagtttgacaaaccattgtatgagagactagagacgtagttatccattcgtccatccatctgtctatcgtcacacagcatttcccatccctcctctatacatacatacatatacagttctgcgtggtctacgcagccatgtatatatatatttccgtcgttttatatattcattactaaaatcgacaatgcattttttgccgctttccatttcctctactttgctcatcacttcgctcgaagaaaaaatgaaaaccgtcttgaaaaacttttgctatttcatccatccaagccacaccaaatagcgcagtcacacagagatcatggttacatatgctggaaaactggttctagctccaatggtaagagccggcgaactgcccacgagactgatggcgctggcccacggtgcagatctcgtctggtccccagaaatcatcgacaaaaagctaattcagtgcgtcaggaaggaaaacactgcactccaaactgtcgactacgtcgtgccgtccaaggttcaaacgaggccggagacgctcgttttcagaacatatccaaaactagaatcctctaaattgattttccagatcgggtctgcatccccggctctggccacccaggctgctttgaaagtgatcaacgacgtcagcgggatagatatcaatgcaggctgccccaaacacttctctatacactccggcatgggctctgccctcttgcgcaccccagacacactgtgtctcatcttgaaagaactggttaagaacgtgggtaaccctcacagcaaacccatcagtgtgaaaataagactcttggacaccaagcaagacactctacagctcgtcaaacgtctgtgtgccacgggcatcacaaatcttacagttcactgcaggaagactgaaatgagaaacagagagcagcccatcacagattacattgcggagatctacgagatatgccaggcaaataacgtgtcgttgattgtgaacggcgctatccgcgaccgctctcattttcatgatttacaagcgaatcattggaaaaacactaacattggtggtatgattgcagagtgtgctgaacgggaccctacagtttttgatcacacttctaagccttcagaagacggtccatcttgggtcgttgcttgtcgcgagtttattcagtgggcaacgaagtttgacaaccacatcggcaatacaaaatacatgttaagcagaattgtccccggaaaatcagtcttttttcagtactttgcccgttgcaagagcccggaagaagttagtttcgtactaaagcaattgaacgatgatggaagcgctcaaacagatccttcagagtacttggaaaactgcagagctcaagaaaaagctttgaaaaacgccaacgccatcgccaagcaaaagaggaaacagaccgatcacataggcagtgacactaaaaagcaaaaggttgtaccccttcccacagatatataatatattctaagtaaaaagaacggattatgaaagaaaacgcgcataatatatatatgtatgtattttctaatttatattagcaactaaattaaattacatcaatactattttttttttttactttacaaggtttatttcaaagtcttcaacaatttttctttatcatcggtagataacatcttgataacttcagataatccatcaatagcattgtcatggtcgcttctgatctttttagctaagtcttgagcgaatgactctaatttcaaaccctttagtttatcgtccaaagttttgtagttttcttcaatccatgttgcgacttgcctatcatcttcatggtccactgaagcagggtaccacgatctaattcttgcgatcttttctaatcttgatgcttcgcctacctgatggctcaaccttttaatcaaatattcttcgttcaatcttcttctcaatctccagaagaagaaacgacgtgcctcggtccattccagttccttagaaataacacccttggccaccatacgtgaagacctatcgtgcaaatcagcaaattgaagactgatttgtccgtaaattggcaatagttctctctcacgatcagctaattgcttggatatttgctgatgtacttctggagccaaactcttgttggataattgagatctcaattctctgtacttgtcatccaatctgttcatggtgtccagcaatttttctctacggaacttgataccaaccataccttgtggttccaaaacaccagctctagcgttgacgtcggcatacatttccatttggtcagcgttgatagttggatcgacaacaacccatgaaccacctcttagttcaccggtaggtgggatatagataataattggttgtttgtaatccaccaatgcgtcaacaataaacgaaccatacttcaagacttcgttgaacatatcacgttgaccaccagagaaacctctccagttggccaaaatcatcattggcaattgttcaccgttgttaaagtcattgatagcttgagcagtcttgaaggcggagtttggatgccaaacttgaccaggttcttgaattaatgtttcagcactatttggattagctggatcagcaggaatcaagttctcgacagttcttgtttcaacaccaataacacccagtggaataccaccaagacgggctctaccaacgacaacacctttggcccatcctgacaaagtttcaaagaaagaccctttatcaaacaaaccatattcaaatccactttcagtctcacgaccttcaatcatccatcttacatcgtaagtttcatcattagttggagtgaaatcaactggtctatcccatgtgtctttagtttccaagataggaactggcatattacgcttggctggaacataagacatccattcaacaatcttctctacaccagctaaatcgtcaacagcagtcaaatgtgaaacaccgttgttatacatgatttgagtaccacccaattgtaagttagaagtataaacttctctacccagcattttgttgattgcaggagcaccagttaaaataattggctggccttcgacctgaatagctctttgacccaaacgaaccaaataagcaccgataccgacggatctacaagtgactaaggtgatagtgaagatatcgtggtaagcccttgacgttgcaccagcaattaaaccagatccacgtagacattcgacacctaacccatcttcagaaccaataattgtcttgatgacaaatctttcttcaccgtttataacagtacgttcagtgagaacagaattttctttgtcaaatttctttaaagtttccataccttcacttgttaagtataagtattggaagcccttgtccggattggcagcatcattccatgcaacttgaaatagtggaacaatctcttcagccataccaattctggcacctgagtttgcagccaagtaaattcttgggataccacgctttctagcatattcagtaaccttattgaagaattcgtcttcttgtggaccaaaggaaccgatcttgaatgtgatatcgttagcaacaacaacaaattgacggcctcttggatattcaggagtctttacagtaatcttaaaggcaaccataccaatagcgttggcaccaggttctctttccacctcagttaattcgccgttttcatcttcaatcaactcgttggaaataaagaaatcatctgttaacttaacatctgcagagaaatttttccattgggatgacgatgcttggcggaataattctgggaagtcatagacatatgtggtacccatcaagtgtgccttataacgttttggttgcaaccattccttaacagggtaaggagtagcaataggtcttaaatgcatggatccaggtttacccaaagacttaaatacccattcaccttttgcgttcttgacttcggtgtacatttctgttttgataacataaccagaaacgttattgatcaaggcacgcaatggtactggggcacctgtttgaggatctttgatgatgattctaatttcggcagaagaaacacgcaatctcaacaatctcttaccaaatctttctaagaaaccaccgaaggcggcttcgacatcttctggagagatatcaaacaccgcaatgaagttgatgaagatatgattcaaatcagaatttgaagtgtcggtgacttctaaattatccaatatatcactcatcaatctgttagcttcagaagtcagatattcttgaatagaaatgtcatcacggatatgacccgttctaataatacctcttgtaaagaatctcttatccaatggagaagtcttactaacagcttcgtagacatggatgtttctattatcagtgaaaattggtttaatgttgaagttggacaatcttcctaattccagttggaaggccaaagccggctcaatgtgacgaattgtttcattttcgttataatttggaccgttaaaagtataatactttggataagacccatctttaaaaccgaacataaatgtgatacgacggatagaagcattgattaattcctgcttattcaaatccaaaatttctctcaaccttaccaaaatttcctcttcagattcgaaaccttctgtagaagcaacacaaacattagcaacattactcaacgatgcggagctaccagaacgatcaggagcaggtccgttagaagaagattggtgacgaggaataacttccaaactttgtgacaaaatttcatcaacatcatctaaatgatccacagccatcaaaataccttctcttaacggagatgactgactgtttgcaacatatgacaaatctgaaacagaaacagccctgttcatacccattttagatttaacagttggaaaggtggagaacgcagctgaaggtagttggaatttccattcaacaattggaactgtgacaccttcgtgaactctaatatctcctatggtgtaagcacgataagcacgacgaatatagacttgagcagctgcagcagtcacaactgggtcttgatgggttaggaattgaagtaaaacatcgaacacaacgtaattagaatcgatcaagtccttcaagatattcaaatctggttcagagcgctttggattggatgagccataggcaaccttcacaacagaggattttaagatatgttcaatttgttcagttctttccttgaccgaaggtaaagcgccttgaatcaaaatttctcttgcttgtagagcgaccttagcggtagccttagattctagttcaacaatatgttgtagaggagtagagaaaatggcagaaactttagaagataacttgcacaatggttgataatgtttcaagatagctaggatcaggttattcttcgctgaaactttcgaatgagacaaaacagttagcgcaactttatctagatctttagggttttcatcacgcaatttcagaatgatattttcctcacgaacatttggaccattgaataacttttcaacttcgtaatattcttccaagaaatggacaaatatagaatgttcatgggcttctaacccgttagagtacttatgagcaatatccgccaatggttccacgacggcgcccagcaatttgtcggggttgtattcaggattcttcacggccatatcaatcaatttacttaattgtctagctgggaaaacagcaccacgtctcaaagaacgtgcaactaactcttccatttgttcatctagcttagcaggcaatcttgaatgtaaagcagagatgtgtagtttccattctgagtaaggcagttttggatttctcaaaacctctatcaattgttgcaaggaagcgttcataataacttggttgtcataacccttcaaaatgttttccaaagtagacactaatgacttgaatttataggcaggtttggttccttcgataactggagaaccaaaatctggcagcataccttcaaatggtagagcgtgcttgaccttggatggatcgtcaagagtcataatagccatgatatcacctgcaacaatggtagaaccaggttgctttaataactggacgataccattttcttgagaaaccaaaggcatttgcattttcataacttcaatttctgcatatggttggcccttgataatgtgttcaccattttccaccaagaatttaaccaatttaccaggggatggagtacgcaactgggttggatcgttttcaacttccaacaaagtagtcatagagtcaacggataatcttgtagcagcaacttcttctttccaatagatggtatgcgatttaccgcctatggcaatcaaaagaccaccatcagatagttgacgcagtatgatatcacatttagaaccattgataaataatgtgtaacggtcattaccggatttagctacggtgaacttgtatcttttaccctcatggataaaatctacagggaacatagtttgcagtaggtctttagatagaacttgtcccttttgtaaggattcgatatacttgtggcgggcttcttcagatgctaagaaagcctttgtagcggcaccgcaaatgacggcaagagttggatcaggcttttcagcggtcattttatgagtaatcaaatcgtccaaccaaccggtggtaatagtgttatcctcgaaatcttcagtttccaaaagtttgatcaagtattccacagtagttctgaaatcacccctaatggacaattccttcagggcaacaaccatgtgtttcctggaagcttgtctattttcaccaaaagcaaaaatatggccgaactgagagtccgaaaaggagtgaatattaccattgttacccacggagaagtaaccccaaacattagaggaagaacggaagtttagttcatgcaaagtaccacccgatggcttgaatccatcgtttggatcttctgatgtgatacgacaagcggtacaatgaccctttggaataggtcttctttgtttcttggtggcatcttgagttttgaattcgaaatcgatttctgaggcagaatgaggattcataccatataaagttctaatgtcacttattctatgcatagggatacccatagcgatttgtaattgagctgcaggtaagttaacaccggagaccatttccgttgttggatgctcgacttgtaatcttgggttcaattctaaaaagtagaattttccatcatcatgagaatatagatactccacggtaccggcagagacataaccgactagtttccccagtctgacggcagccttttccatctcgtgaaatgtttcagccttggcaattgtaactggtgcttcttcgataattttttgatgacgtctctgaacggaacagtctctaccgaacaaggaaatatttgtaccgtactgatctgctagcagttgaacttccaagtgacgcgctctaccggccaacttcatgatgaaaatgggggagcctggaatttcgttggctgcctggtggtataaagcgatgaaatcttcttcacgttcaacttgtctgatacctttaccaccaccaccttcggatgccttaatcatgacaggaaaaccaatacgcttggccttttgtaaaccatcttcaggagaggtacaacaacccttttgatagatgtcatcgtcgacagagaccagaccggttttctcgtccacgtgaacggtgtcaacaccggtaccagaccatggaatacatgggactttagcactttgagcgacaatggtagaggagattttatcacctaaagacctcatggcgttacctggaggcccaataaagatgactttcctcttagactgggacaatttttcaggcaatagtggattctcggaggcgtgaccccagccagcccatacggcgtctacgtctgctctttcggcgatgtctacgatcaagtctacgttagcgtagttgttattattagtaccacctggcacttcaatgtattgatcggccatacggatatattctgcgttggcctccagatcttctggggtggccatggcgacgaattggacggttctgtcatcgccgaacgtctcgtatgcccattttctgacggatctaatttctttcacggcggcaataccattatttgctatcaggatcttggatatgaccgtgtgaccaccgtgactcttaacaaagtcccttaacggggactcctctagtttatctactgtattgaggccaatgaaatgacctggaagttctgtatgtctttctgagtagtttgtaatttcgtactccatcttctgtggagaagactcgaataagctttcttcgctcatggtagaaacttgattttttctaattttctgcgctgtttcgggaacggaaaaaaattaagctagaagacgaatcggttattatactattatatttgtatagtatagtagcgtgtcgtatcgtatcgtgtcgtatcgtatcgtatcgttaaaagaaaatacacgaataaataataatatgtggagaagaaaaagggaagtttcttgtctcttgctctgaatctgaattccaattcaagttcaaattgttctctagtttattgtccaaaaataaggatgaagcgggagggaagggcagagggaaaagttcgtatagtagaatgaataaacttttataaacacatgcaccgatcactcacagaggataaaaaaatggcacaacaaatatatatatatagatgcaaatggcgattgcaaattagggaattggctttgttgttttttatcttcaggtaaactgtacgaaagggataaaaagagtagaataaggaaaggaaaattgaagagagcagaacaattgtagaaccgataacaattgtgacagtgattgtgctaggctatactgtgccagaatacgactgggagtgctgttcttcttatatatcttggcgctgattgagcgtatagcctagttcaccaagcagtagagagagtggcaatgagcggttgaatttcgactgcgacttgttggcacaacgcgcgcgcggccgggccatgtgaagattttaacgggcgcaacgattcggtgggcagtggaaattgttgggcgttgttcaacaagatgaagcattcccctttggataacgtcaacgcatatcgggccaacctacaggcaatgagcgaaagcgactgaagccgagagatgtgcccggagtttgttgttcttgttcttgttcttgttcttgttcttcttgacggatgatactagtcgcagtcgtggtgactctggagggcgtaacggccgtgatgcggcctgagctcactgtgacgtcgatgcatgcgcgggttcgttgcgttcaggcctgacgggcgattccccaccaagtataagtgtcatgatatacgcggcacctgagcagcacattaggtcccaattcaacccaacatatataatggttctgtatgggtattttaagtgtgcaaacaaaatgtgagttacccggctgtttgctagtcgctgcgtacgaactggcttgctaaagctgggtaaaaataatttaatcgcaaaaggaagaaaaggaaatcgacgattcattgaaaaaaagagaaaatactgaaaaaaaaaagacaccgacaaaaaaaagagagaaaggaacctttacgtagagcaaaagggaaacatttgttgcgtttaattaatagaaataataggttattgcattcgccctccattgcagaaaaaaaaaaaaaaaagaccattttcctcttctactctctttgcctgtacatactacacgttatagcgttaacaaaagcagatagaaaaaaaaaaaataaccaagataatataggtatacttgtttaacagatcacacacaatcatgtcgtggctttttggagataagacacctaccgatgatgcgaatgctgccgtgggcggccaagatacaaccaagcctaaggaactatcgttgaagcagagtttaggtttcgagccaaacatcaataacataatatcaggtcctggtggaatgcatgtcgacaccgctaggctgcatcctttggctggtctagacaagggtgtggagtatttagatctggaagaagaacaactatcctcgttagaaggctcacagggtctgatcccttcccgtgggtggaccgatgacctatgttacggtaccggtgccgtctacctgctgggacttggtatcggagggttttctggtatgatgcagggtctgcagaatattccgcccaatagtcccggaaaattgcaattgaacaccgtcctgaatcacattactaagagaggtcccttcttaggtaataatgcggggattctcgcgttgagctacaatatcatcaattctacaatagatgcactaagaggcaaacatgacaccgcgggctccattggcgctggggccctcacgggcgctttgttcaagtcttcaaaaggtttgaaacccatgggttattcctcggcaatggtggccgctgcgtgcgccgtctggtgtagtgtcaagaaaagactacttgaaaaatgagcaacacaagaacctactctctctctctctttctctctctctctccctcttcgcttttcccccatgcactgatggcgcttgtatatagcatttgaaaaataatagtacgtaacgcagaaaacaaaccaatgaaagtagaaacccggagaaaagatctaaaaaaacaaaaaaaaaagatggaaagagcgcatgtatgtgtagatatgtacatatatacaactacttgtatgttatttgccttttgtactgttaagctattgttttcgatggccaattaaagtaaaacaaaccgctcactctcgggtatttcccgaaactgtcagagccgtcccggcccaccgattcgcccggcaagacctgcttggaagcagcacaaagccctgcggcctctgtacacctcacgctaaatagctgctaacgatcaacacctgaccgagataacagcagcaaagaacccgcaaaaaactgcgccgtctaggcctcaacccttgcttcctacaaccaaacaatggtaaaatatacaaaaaaaagaaaagaatgctctttcttatttcccttttaacctaaccatcttttgttttttgtcgtttaacctggaaagaatgttctattatataaacactctttactacgtctttagcttgaaaaaactcttgacaagtgcaccgatactcaccaacatcgcacaatgaagattttaacccaagacgaaattgaagctcatcgctcacatacgctaaaaggtggtattgaaggtgcccttgccggatttgcaatctctgctataattttcaaagtcctaccaagaaggtacccaaaattcaagccttcgactctaacatggtccataaaaaccgccctttggatcacccctcccacggtcttgactgctatatgtgcggaggaggcctcgaacaatttcgacgctacaatgtacggatccggttcctcctcggaagacgcactagatgagcacagaagatggaagagtttgagtacaaaggacaagtttgtcgaaggtctatctaataacaagtataagatcatcaccggtgcctgggccgcttcgctgtatgggtcgtgggtaatcgtgaacaaagaccccatcatgaccaaagctcagaagatcgtgcaggcaagaatgtacgctcaattcattaccgtcgggctgctgctggcctccgttggtttgagcatgtacgagaataagttacatcctaacaaacaaaaggtcaacgaaatgcgccgctgggaaaacgcactgagggtcgccgaagaggaagagagactcgagaaagagggaagaaggaccggctacgtttctaacgaagaaagaataaactccaagatcttcaagtcgtaaacctcgtcggtttatctgcctcaactttatttccgctcctcgtcttttataaaattcctttcatcaatacatctatatattcgaatatatagataaaccaatacaaaaacatactgaaattttttgaaaacaactaaaactattcattgcagttacacgtgaatgctaaactttatatcgctcttgtcggtcccgcggagttaacatttaacggcttctcgcgcaataaccggaaaaattccaacagtttctttgtaatattattaagccttcttttttcccggaatctataagaggggacgaaaattagccgctattaattctggtattgccacctagacaagaagtaaacagacacattacgttagcaaaagcaacaataacaaacacaaccatggacaagaagaaggatctactggagaacgaacaatttctccgcatccaaaagctcaacgctgccgatgcgggcaaaagacaatctataacagtggacgacgagggcgaactatatgggttagacacctccggcaactcaccagccaatgaacacacagctaccacaattacacagaatcacagcgtggtggcctcaaacggagacgtcgcattcatcccaggaactgctaccgaaggcaatacagagattgtaactgaagaagtgattgagaccgatgataacatgttcaagacccatgtgaagactttaagctccaaagagaaggcacggtataggcaagggtcctctaactttatatcgtatttcgatgatatgtcatttgaacacaggcccagtatattagatgggtcagttaacgagcccttcaagaccaaattcgtgggacctactttagaaaaggagatcagaagaagggagaaagagctaatggccatgcgcaaaaatttacaccaccgcaagtcctccccagatgctgtcgactcagtagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggcgttttggatggctattgcatttggtgctgtcaaggctttaatagactattattaccagcataatggtagcttcaaggattcggagatcttgaaatttatgactacgaatttgttcactgtggcatccgtagatcttttgatgtatttgagcacttattttgtcgttggaatacaatacttatgcaagtggggggtcttgaaatggggcactaccggctggatcttcacctcaatttacgagtttttgtttgttatcttctacatgtatttaacagaaaacatcctaaaactacactggctgtccaagatcttcctttttttgcattctttagttttattgatgaaaatgcattctttcgccttctacaatggctatctatggggtataaaggaagaactacaattttccaaaagcgctcttgccaaatacaaggattctataaatgatccaaaagttattggtgctcttgagaaaagctgtgagttttgtagttttgaattgagctctcagtctttaagcgaccaaactcaaaaattccccaacaatatcagtgcaaaaagctttttttggttcaccatgtttccaaccctaatttaccaaattgaatatccaagaactaaggaaatcagatggagctacgtattagaaaagatctgcgccatcttcggtaccattttcttaatgatgatagatgctcaaatcttgatgtatcctgtagcaatgagagcattggctgtgcgcaattctgaatggactggtatattggatagattattgaaatgggttggattgctcgttgatatcgtcccagggtttatcgtgatgtacatcttggacttctatttgatttgggatgccattttgaactgtgtggctgaattgacaagatttggcgacagatatttctacggtgactggtggaattgtgttagttgggcagacttcagtagaatttggaacatcccagtgcataagtttttgttaagacatgtttaccatagttcaatgagttcattcaaattgaacaagagtcaagcaactttgatgacctttttcttaagttccgtcgttcatgaattagcaatgtacgttatcttcaagaaattgaggttttacttgttcttcttccaaatgctgcaaatgccattagtagctttaacaaatactaaattcatgaggaacagaaccataatcggaaatgttattttctggctcggtatctgcatgggaccaagtgtcatgtgtacgttgtacttgacattctaaggcatcctgcaactgttctgtggagctattaaatctttatagtaaatttttttttacttttttttttttttttttttttttttttttttttnnnnnnnnnnnnnnnnnnnnnnnnnnatttacaagcgtctatatattttctattatagaatattgtcatttattacattggttcatctgtaaatctcatcaaacggtctcgtatcggcgaagcaactgtcccaaacttcatctacaatttttgctgcatgttctttgctttggcagttggggttccccgaaacactaattattgccctccttctaacacaatcttggtgtccccttgccacatggaatcctgtcctaaaccctcttctcttgaactcttcccaaaacctgcattccccacttaacgaagaggctctgatttcagaacatgcatgatgcttcagatttaaccaatctatttgccattttagatcatcgaaataatgaattaattcatgcgaaagcgtatcctctaaatgccacttatcacgtaacctgttctggcacaataggattcccaattcaggatgaaagccaccgcccttccagtcgggacagtaatcgcagatgatcttcgaatcgtcgaatttactgtcgctacccttattaagtttcgtaatagcttgtaccataaagcgaactgtgggagagtatttaagcatccaatctcgatactcataacatttcagacattccttttttagttctcgagctttagagtcgtcttcgtatcgagttttctcctccggtgtcaagcctataccagtcttgtactgcatggtccgtctccaccactcaaacccagcattatccccactgctattcatatcgtgccaaaaaaaaaaaaaattcggtactatcagctttccttggttttggttgtacaaattatgccttactcttctgatcattttgatattagaactcttatttttcttatttgttcgcatcgtcataaatgataattggcgaaaacgcgccaaaaagtgaaaaagtgagaactacttgaaaaaaaaaagtttgatattataggtattattgctcaaataggtacgatattgttgtaggcataaaaattagattagcagaacccttttccatttcattaacatgtctagttcaatatttggcccacttacgggttttttggagcgtgtcaattcactcaatgcgccctaccaagcattatcatatgacgaacaaaaggccatgactatttggcaaagagtcaaattctacaactggacttttgaattgtgtgctctaggtgtgttgttcttggtttatgctttctacaaatttggtaactccgttaatttgaagcgcggaaatcagattttccaatctttgcattcatttttggccaacgacttaaagttctcccgtgtagggttcaatatcaatgattccaaaatctttacagtggaacaccaaaatacatggttctcttcttttgctaccggtagatccgccatcaagagcatcaacctaaaccttcatctggtagcccgtagcaaccctttctctatgtgtctagagtacctgcttggatttttttttgcaagtttgaaaagtaagcaattggaagaatttatggagatcgtgatcaggccaaatggtattttagttactagtgaatctgctcatcctaacaagaatgcgcatgaaattttgaccaaatttagatttgtcacttctattgttaacaaagaattcatgaatcaagctagaactgaaaactatttcctgtctattgcacacactagtgaaaacgataaactaccaaataacttcgtctacatgtccgatgttaatcaattatcagggttcatgtttcattactccaagccctatgaggttttgtcccaagctggtaatcttttgaaatatataagtttcaccgatttgcctgtcaacccgccacgcgatgataaagaatgggaatcttcaattgaaccaaaggctatcattcgttgcgctgttccccaaaatgagaatgaattgaagttgttaaaccaaattatttccttagtcgtagaaatctacgatgggttcactcaagatttagtccaacagtctccaaacttattcattaccaacgacatcttgaaaagaactaccaacttgcgtcagcaagaactgaacaagatcaaaaagtttatgaaagaaactgaattggaattggcaaaggagaagaaattagaattggaaaaagccaaaagacgtcaattgaaggcctctggtcaacaagaaaaggtagatcaaaaaatgaaagagaaaagagaaagacgtctcaaaaacaagcaaagaacaagatttcagtaagaaccactttgttcttctttcctccttataattttctgaacctcttcagtttttgtatacgaacgttttccatgtatccatacatttaaatagtaagtatgtaaattggtatgtggtgttttgaattgcgatgttgcctatatacaagattgtacgctatctgaatacatactctttaccaatcaaatgtcaagaccggggatcttaacctcttcgatagtaatcccagaatccaataatcccttcttttcctcttttggcttctcttctttcttgtggccaaaaacagattctttacgtaactccatgttcttttgaacttccgtttcatggcgtttagagagctgttgatggtcttcctctagctttgcctcaagtgtttggtattgttttaacagttccgtatttatgtcgtgttcttcgctgagtatgtattttgcaccattgaagttatgtaaatagtttctcattaaagatggtttgacatttgcaacttgtcctttatataattgaaatcgcgggaaatccttcaggacttgaaccttgaccctgtgggttctctttgtcagagcgctcagacacacctgggtgcaatgtagcatctttggtcgacctgtttcgttcgttatttagttagccttttatattccttacggtataacgtaacttaactgccctttgagtttgctttttcatcggaaagaacaaatgaactaaaaacttgcaataataaacaaaaaaaatacaaaataacgtggatgtattaaaccaaaaacaaaataagacaactctaaagctgtcaaacagagatctaacggattgaaccatgtccaaagtaatgaaacccagcaacggaaaaggttctagaaagagttcaaaagcagccacacctgatactaaaaatttctttcatgcaaagaaaaaggatccggtgaaccaagataaagcaaataatgcttctcaaattacgccaacagtgccacattctcatccatcagatatggttatccctgaccatttagccgaattgattcctgagctgtattctttccaacaactggtggattccgagaaaagattagatcattttattcatctgcgaaacttacatatgaagcgaatggttgcgcagtgggagaggtcaaagctatcccaagagtttctttatcctcatttaaattttccaaatgtaaaatttctccgaatcttcatttcaaatgttagtgaaaaccaaccctggcaaatggacacaaacaatgaggctgaccttatggcactggagaatgccacttggacgatgagaatcgaaggtcgattattggacaatgtgcaagctaatgatccagcaagagaaaaatttagctcattcatagaatcgatagtggtagacttcaaaaataaggaaaacgataatgtgccatcgactaaatttaatgcggcccctgaagaaaatgccaccgaaggacccagtgataagaaattgaacttaaacttaccgttacaattttcactgccgaatggtgacaactctactacgactaataccgaccaaaataatgccacgatgggggaggagactgccaaaaaggatatgagttctacaactccaaaactagaatcagtgaaatggcagtatgacccgaataatcctgtagacttcgatggtctcgatattaagagggtagggtctgaaaatgtagaatgcactataagcatcctgcgaaaatcatccccagaagagccatttatgagctactctccacaactaaccgcaataataggattgaagagcggtacatcacatgatgcaatattttccatatataaatacatccatttaaatgaattgcttaccaatgatgagtctgcattcgaaaatttgatgggcaacaggaacaatcacaatagcaacaccagtactagtaagatgcttgatgcagcctccagtcaagtttctattgtaaaattagacactcagcttattaccttattacccagcagtcttaaagaatcttctccagatacaatgaaattaacggatttactgtcccttattaatagtactcacctgctcccattacagccaattgaaattgattacacagtacgcgttgataaagcttccacttatggtgagttggttcttgatattgaagtacctgatgtcaacgctctaaaattcaataatacacaaagagaaagtcaaattggggctgctgaattgaatgaaaatgccagggaattggaacaaatcaaacccaagatagctttacaggacaaagaaataacgtccgttctctcgaatctacacgagagcaacaaacgataccgtttcttcaagaaaattagtgaggacccagttaaagcattaaatgaatgcattgcttctacctcgaatgctttgaaagttttatcgggagatgagggctataatgaagatatggtaaggcgggctaacttttacaaggaaaatgaagctatgttgcgcgagaatatagaagtcatattatcaaatggacgaatgtaggcttctttacattgatacacaatagactgaagatttatgtagttttctttgtatataaactctagataggaaaagaaaggtcaccattcatttataataattaaagacgaacagacaatgctgatttgtttatagcgcctacaagtaatggcggctgtctgattccattgtctctttctaagaaaagcgctgaaaattttctactggaaatttcagaatatgaaaaagtagtagagatgagggccacttaaacacaataagcatataaggaaccaagggaaaagcaacaaatgagtgctaacaatggtgtcactggcaaactctctagtagagtcatgaatatgaagtttatgaaatttggtaagacggatgacgaagagagttccaactccaatacgccgtctaatatcaactcagatgtggaacctatagagcagaaaggtaaactctttggtctggatgactcagcgtgggacctcaatagctacaaagatgatttaaaaaaaatttcaggtaaggagaagaaaaaggtgaaaagagtagtatataagaagcgacccaatctcataatctccaacgttggttacagtgaactgcgaaaacctgagggtgtgataagtgggagaaaaacctttggcgataattctgatgatagtggttccaggaagagaaagtttgatgaaggcgaacaaaatgaagacgagaaaagggatgctaaggataaggaatttacagggagccaagacgatggagaggatgaatatgacctagataaattatttaaggatagcatcaaaaagaaaaagaccaaccataatggtaaaaataaaaatagaaattcaaaaaagtagcgcagacaatgcaccagcagaagtacgtattcgtatataataatgagaacataatataaagcattgtgtagtatttttttcgtatttgtcataaaccataaggactgccgtcctttctattacgctcaattccaaaacatatacaaaaacatgtaaatacaccacttctaatttatcagataaatctctatcatcaatatcattgagatcgtttttgtatctttgcgttttttttcatagcttgagtgtcgtcactctccttttcgctacttcattattgctacctcataactttctctcaagctcaagcatcatctatttctcgaaaagttgcgttggtgatctcaaactctgcccctccagtattaataatgttactttcagtacataagacttcagttccattcacagaactcgtctcatgcacgccatgcacttttatggaatctacgctaggtacagatgtttttgtaccgtggttgccaaacaaagttgtttgatgtaagtcttcatcaactacgtagggcgaagagatggtgtctcttttcgttagaaaattgtccttcgcgtaattgaaaagcatggaatgcaaattgtgcttataggagaactgtaaaatgtaagaaagcagcacaataaggatgaagttggtgaaaaatttagagattttttgtttcattgaggtgtagttggcgtagttaagcggtaattttattatgtggatagtgttggctgccgaaacactcgccacatatgtagagtccggagagatagtgacctctgtaatggcaaaactatgagcttgtttgaatattttagacattgacaggtcttttagtttcacaagagctatggaattgtcattacttgccagtaccgccaattcacccttcatgtcgacatccatagaagtaatccctttgaatctgtttgtcacttgtttggatcttaatacggaagtgtttcctgatttgatgcttattttggtcagcacaatacctttccctttttttaaagaggctgctatcaatactgtgtcatcggctatgaagtttattttagataaactccaattcttatcaaaatctgttttcctagcaatgcaacttccagtcactgttgaaatcacttccaagctagaaccggtgatataagcaacaaccttaccatcagtggaaaagtgtaaatcctttacttcacccctagtctcgatctcaaacttctctgtcaagtcgctcgggtcaatgattctcattatagcaggtactttagatgatgcgatagctgcaacggtaccttctcgtgaaatataaaccagcttcgtgtagtcatccgcatttgtagatgcgtcaaagtctacactagtgaggaactccaattgatcattcactttatcgtatttaaattttctcaagtgcttattacctttaccttgggtaatcttagtgctattttcattgcagccaaccaaaatgatacccttggaagcgtcaattgcagtaggagagtcgtcgttgtcttccaatgcaaactcgctcaatatatgaaactgttccttctcagtatctttggtaggatccacgcgcaagaccgtcagcttgtttggtatgccattgtttccttctcctccaccgcctgccacaagtaatgtgtcgttattcaaaaattttgcaccgtacgcaggatacccgacgttataactagctgtcacgaacttcatagtggctcgattgtatctcaaccttgttatatatctgtatttctatcacgtatccttctaggtttctgtacacgtttttgaattttttggattttttttttttcaacttttcttttttccctcattcttactctattgtcatcaccattcaagataaagataataactagctttgagaaattagaccagacgcagtggaaggttgaatacatgcctgtgtgagggtggtgccaatgaccagtacattacatacgacaaaaaaagtgctctccattcaatcacacgtcatacatggctacgtgggaaacaaggccgctacgttcccacttcaatacagaggttgggatgtggacgtattgaacacagttcagttttctaaccactcggggtacgcccacttcacaggcttcaaatgcagcactgaggagttggtagacattgtagagaagggcttgattgggtctcttagaatcaagtatgatgccgtacttagtggctatttacccaatgttcaagccctgcaaaaggtagcaggaatagtgggtcaattatgtgaggggagtgaaaacgtcaagtggatattagatcctgtactgggcgataatggaaggctgtacgtggatcgagaatgtgttgcggtataccaagacattttacaaaacttcaaaatttttttggccacaccaaatcagtttgaaatggaactgttggtggggatgtcaattcgtaccttagacgacgctaagcaggcatttaaactatttcataaaaagtaccctcgagtaagccgaatagttgtcactagtctggaattatctgaattcctgagcaacgacacttacgtagtagcagggtttgattgctcggccagtgaagagatattcttctatgaaatccccaagatcaacgcaaaatttagtggaagtggtgatttaatcagcgccatgctcactgactcgttactaggcgaccgccgctgcacacagctgtcattaagcgcatccttgggccaagtgctgtggctcgtcaccagtatcctacaaaaaacgtatgatttaaacatagctgagcggggcccacaagattccacgatagatatcaaggatttaaagctgattcagtgtagagacatcctaaagcaagatctcataccctccattggcaagccaaaaaccattaaaatatgattcttacgaaacggtatgctccttcctcattggggtgcggctgctgcaggaacctgcctaaataggaaaatacattcctgatttggaaactgtaggcacacgacgcgtccctttggagaagatcgatccttctttgggtctttcaatttgattggaaaaaaaatatttaaaaaaatagaagaaaaatatagaatatatagaatatatagaatcaactactgcagtagataaataaagaagactattcatattcagtatcacaattgaaagattattacaatttgtatacattggttcccaatgaagagcttttttctttatctttatgtggcattcatgtttagttgcataacggctctgccattacctgtggataacaaaagggcttcttcagactccttagacctaaagaaaaaatacgcaccagaccctcctattacacataatgtaaacatcggaattgttttcacagatcctgaaagttcggaagaagccggccgtctcataacaatagacttatacgggactatggtgcccaagacagtaatgactttttgccagtatgttgatagtgtaaaagatcgccttgcttcccgtcacagttactcgccagaacgcgattttgataaaattctaccgaatggagctatagaaggtagctccgtttcttcctcctctattgaagaaacggaaatgttggctccaaaactcccggaagaaaatcatagtttaattcatgataggccaggcagagtttccatgattaaggacgataagggtcttaagtttataattgagaccagtgagacgccacttgaaggtgaaagtgttgtgtttggccaagttaccgccgggttaaaagatctgatggataaactagctaatgtgaaaactgacgaaaatggcaaaccagagcaaccaataacaataggttacatttcatcccaggaacacaggattcagcatgcaaaggaagctcacgaaaagtatttacaaaggcttcaagattaccaaaacggcgatttggagaaaggtattacattgaagaattatttataccagggtagtcaaagaaagttagaagacgcaaaatataatcagcttcaccatcctttaccaaagattatgcttggtatttcggtattgttacttttctacgttttggccaagtacaggaaaagaatattcaacagatcgtctaaaatagtttctattagagaggattaaaatgtttcgatccatccgcttaatattcattcattttgtatcacatacatacgtataaatatacataacttacctcgtctttattatgccaaccatcattccagggttttacgtaacagttcctctatggattccttttctaggtacttcccaatcagcacaattttacactctttattggatccgtcatatttgcctggaaagacatcgtaggtgtcgcggacgccttggattacacgagcaatggggttctctccttcaataagtatcagacctttagttctttgtacttcccaatcacggccgtcatctcggcgacgccctcccagcactgtcatggctccaaaattcttccacaataaaggttgcaaaaattgcttaataaacttattattatattcttcctcgttttttaatggtctgaaagtaagcattattgtgcccattcgatcatcatgaatggtaccgtttccgctaccactatctaagatgtcagatatccgtacactgtcgtatgcatgaatatctagtaaattttgaatcggcgtatcactatacttggtgaagaacatcggtgcgatagaatttatttcccgtactctttcttttaattgtttgaccatttctggtgaatgttcgatagtatcgtatttgttcattataattcgatcagccatggctagttggaagtgtgcaatagtcagattcccctccaaaccaactttgtcaccatgccaatgggcatcgatggaaatatcatctaagcattttagtatatgctcacaatccaaaaccgtgatgatcccgtcaatgtaaacgctgctattcaatccttcgtcctgccagaacattttcgcaatgggggcgggatctgcaataccggaggtctctaaaaggatataatcgattttaccaggtgaacgctccaccatatcttcgatggctttaacacctatatttttcaacgaacaacacagacacccgttacccaaatccaaccattcttggtagctgttcgatccatttttaatggtcatagccttttcgatttcactagaatctccaaattcatttaaaattacggcaatttttttatctgcaccttttaatgcaattttttccagcaacgtcgatttacctgatcctagatagccggtaataatgctcacaggaatacgctttttctcgtgcacatctgttgcgcctgcagaagtgttctccacttgcttgtttaccctttcaacttttgcatcgctaacaatatttccaccatcatacgagacattttccaaaatttcttgtagattattttcttcacctgttacgaggcagggtagttcaccatcttcttcttcattgaacttgatgtttctcaatgcagacattcttccgctttaaaagttgaaaattcctcaatgaaaagggtgttcttggctttacaagcgcattaaacatttaatattatataatatttataatatacatgttattccaatagtgaaaaaaaaaaaaaaatgaaaatgaaaaattcggcccttaaaaatgaacaaccttttaccagccggcattaaatgtcgtggcacttcacagtttataacgcaaggaatttactaatagcaagtgaaaccattaacgattagtgttgttaaaagagttgaataaagccattaaacaacgattcagttgacaatgcgttggtctgtccttgatacagtgctattgaccgtgatttcctttcatctaatccaagctccattcaccaaggtggaagagagttttaatattcaagccattcatgatattttaacctacagcgtatttgatatctcccaatatgaccacttgaaatttcctggagtagtccctagaacattcgttggtgctgtgattattgcaatgctttcgagaccttatctttacttgagttctttgatccaaacttccaggcctacgtctatagatgttcaattggtcgttagggggattgttggcctcaccaatgggctttcttttatctatttaaagaattgtttgcaagatatgtttgatgaaatcactgaaaagaaaaaggaagaaaatgaagacaaggatatatacatttacgatagcgctggtacatggtttcttttatttttaattggcagtttccacctcatgttctacagcactaggactctgcctaattttgtcatgactctgcctctaaccaacgtcgcattggggtgggttttattgggtcgttataatgcagctatattcctatctgcgctcgtggcaattgtatttagactggaagtgtcagctctcagtgctggtattgctctatttagcgtcatcttcaagaagatttctttattcgatgctatcaaattcggtatctttggcttgggacttggttccgccatcagtatcaccgttgattcatatttctggcaagaatggtgtctacctgaggtagatggtttcttgttcaacgtggttgcgggttacgcttccaagtggggtgtggagccagttactgcttatttcacgcattacttgagaatgatgtttatgccaccaactgttttactattgaattacttcggctataaattagcacctgcaaaattaaaaattgtctcactagcatctcttttccacattatcgtcttatcctttcaacctcacaaagaatggagattcatcatctacgctgttccatctatcatgttgctaggtgccacaggagcagcacatctatgggagaatatgaaagtaaaaaagattaccaatgttttatgtttggctatattgcccttatctataatgacctcctttttcatttcaatggcgttcttgtatatatcaagaatgaattatccaggcggcgaggctttaacttcttttaatgacatgattgtggaaaaaaatattacaaacgctacagttcatatcagcatacctccttgcatgacaggtgtcactttatttggtgaattgaactacggtgtgtacggcatcaattacgataagactgaaaatacgactttactgcaggaaatgtggccctcctttgatttcttgatcacccacgagccaaccgcctctcaattgccattcgagaataagactaccaaccattgggagctagttaacacaacaaagatgtttactggatttgacccaacctacattaagaactttgttttccaagagagagtgaatgttttgtctctactcaaacagatcattttcgacaagacccctaccgtttttttgaaagaattgacggccaattcgattgttaaaagcgatgtcttcttcacctataagagaatcaaacaagatgaaaaaactgattgataatagctaacgtcaattccaataaaatatatagcgagcgttttacattaatccacctcgactagacttcaaattttcacttttatatcttacctttataaatttctgttctcaaaatcaaaacaattataaaaaaatgctatcattaatcttctatccttgaattaacattatatactctccccccactacattatattttgattttacatataatacaacaaaccttctcaacttaactactctctttcctcagtatctgtagaggaagaatcgtcgccaaaggctatttctctaatttgtacaatccaaggatccatcaacagctcaaccgcactggctctcttggaggggttttgaataagacatctttccagaaatttcataccagcagacgacacttcatccttagtagggaattgtggggtatgtcctgcagcaacatggtacatgatagcccattcattatctaagttagcccatggccgtctaccagtgatcatttctaataccacgcagcctaacgaccaaacatcgtctgccccaagtttgcctttggtggtagatccagtgatggattctggagccatgtacataggagttcccatcatgtctaatagagcattttcgttatttttcactgcctttgaatcagaaacatgggtaacatcttcgtgttcaccatctgcgttttcgattttgttcatacttgccaatctagttccattattagcaatttttttagcagcaccaaaatcaacatacttaataacaccattaaaatctagtaggatgttttcgggtttaacatcacggtgaacaatgccggattcatgcaaatatgcaagtccttctagcaattgtaaagtgtagacttgagtgaccatttcatcttcaatacgaccatgctccaaaagagctgctagggaaccgccttcacaatattccataaagatgttaactttatcacgatgaacttcaacaccgtaatatgaaactatatttggatggttcaatatctctaagacactcatttcctccttgattaaggggaatattttttgcattgatttgctatcttgaatattgatttccttgactgctaaaatctcaccattatccaaatcaacagcagaatatacccttccaaaagtaccgccaccaataaagttcctcttttgccatctcatagaaacgttcgatatggaagatgccaaagaaacaaggtacttgttacctttgtcactatcatcaattactttaccagtttgatgaggattccgctttatcctttcttccaattccattatactttgtactcggaactcggaattcacttgtagcatcatatcatcgtcaaacacatcttccaaatcaagatttgatctagcttgttgattgattttctcaacttctatggagcgtgcgcctattatatcaaaatgagaaataagtaatgacatgcattctgaaattttttgttttaaagaagaaaattggcattcatcaagagctagtatgttccaaccgcttaccatatgcatcgcgaactccattgacgtgacacaccacctaaataccctttgatcagtcggatcacagtcttcagctaagaacttcagccatccgatacttaaccgcatcattaaaagtattataatggatcttttttcattgttggcaacattaattctcaaaaagttcagaccaaaatccctcccaaaaaggaaaatattattcaataaatcattgacaggacttaccttcttgaacgtggtcacaatctttgtatagttcttcagaacactgtacgtgcatctgaaatatgctttatttatcctttgtaagttgtttttaaccgtttctgaggaagattttttttccaagaaagaaactgagctaccagatatctgttggaacctgtcacattggtattctaaggcataactggatccttggcacatcaaatctattgaattaggaattactttcaagttcaatccctctggtttaattgttttgttatcggatagattatacatctcaccctcccaaagtaatggctcttgcggagtcaataccaatacataaccaagagagttcaatcttgtctccagttcataaaactcttcctccgtgctcctgctgttttcaaaatccggttcacgattgactctattaccgttataagatctaggctgggtggtcaaatcgtttttgatataataaaatggggtaccatcattcgagatatctgaacccagtgatgagttggagttccaattatcatccaaagcattataaattgtcagactgttattaatttctagcttaggcactaaatcacaaccgatgtctgaattcttaatgattcttaaaatatcatcatctttacagcctaatagctctgggctaccaattaaataagtaccattttgctctaggtaacctcctgtgtatataagaaagtggcctgtttcttttagttgctttagcagatagttgtgatcttctatcttgtagcggacaaaattttgaaatgcttttgtcaaaatattggtgaatctattgagttttcttttcatggatccaagtatttcgaatatttgcaccagccatttttcagcagcagcttcattctctaattttggcggagtgttttgctgccttaaaaggtaagcgtgcaatctgtgaaccaatctaagtgtcaacttcgtaaattctgctgcgatcagttcgcctgcatcatcaatataatagccgacgtttctaaacatttcccaatattttaataacagatcaggttctttagaagtcttgaatgagtttttgccactatataatattctcagttccaaaatggagaaaaaatattccaatccttcaacaacggtatgatcaaattcgggatcgattttcactttaaaaaaccagtcattacagtaagaagcaacagtgaatttcatttggactgccaacttaatatatgtactaaaatcgtccatcatttgatcgatcatcatcaaggttggattctgtattttcttcgcgtaagataggcgaattagtattatatcttttaccaaacgcattggaaacatcaataaaaattccagatcttgatccaaataagatagattcaattcattccaagttttttggtatttcaagaagaaaaatttggccttcaaaatccatggtgctaatggaaagaatatttttttttgaaatatcagttcaatatccttttccttcataatttgctccgcaaagcgtttacaattagtggcgaaaacggctggatcatccaaattcacggtggtgttatccacttcggtagtgctttctagctctttattgccaactatccattttttcaggtacgcaatattagtatcaaagttaaatttgaaattaagccaactattcaaagtatctattcgattcctgaatgcttctgttttagtaatgggtttttcagcatgcattcttttaatgttaggccatagatttaagactctataatatttgtctactagtgatttgatagtctctgcagcctcgtcagcgctcatattatcttctagtttaaaggccatgatttcttgaaatacggagtcagtagaatccctaaaaatcctcagagatttgttctgatcttccacggtcctcccattcatccatgccttcaactcaatccaaatgtcatctgaaaactgagtattgaagccagggcctttcccttgatttgcaatcttcgttttttcattcctcacaatatctcccttcagtaccttagataacattgtttgccattcaaatcggttgttcaccataggattttgtaacaattttgacagcaaatcctcgctccccagtatggaatgccactcctcatcttctatttcacacggttgatcattgttcacatccctcaaccaatccaatttgccctttagataatttaggctcatcgaaacaacattttcattattttttgtgctcgacgtaataaaattataaccaaaattgaagtcgttatctttatcctcaccttctacctttaaaagatcatccatttctagttctaagtcatcttcacctttgttactaaaattttcttcgtcatcttcaaagttggatgatgcgactatacctctagtgtaataatcatcattagcacggtttctcatttttcttaaatataactgttcatttaatacatattgttttttgtatgttcggaggctcgttgtgcttccaccatggtggcctacagaccgttgcgagctatttgtcgtgacaatatcctgcaaagtggaggaacttgttgacccatttggttgcgatctggtgggaatgtgtttgttcgaagtttggtttgtaatattttgtggcgttgacataatcgatgtattcgttgtatttagtgaagccagttctggtgatatcactaacgttggggtcgtcaataatggatcttgattactattcacgggagcgggcttcttaataatctcgctctctgttttactagcctcaactttcttatgtacaggaacaggttgagtagacaacttcggtagagactgctgaggattttttggtagaggaagaccaatattcgagggccgtctactagatcttgccgaggagctggaggacccagaaatggcattttgatgaaaaaactgaccttgaggtatacccggaagacgattgaatagctgtactgtatttaatggagactctccagggctgtaaacagcgtttggtgatctaaagtactgggtagaatgcagccctgggctgatgggcgatgacgctactcgagcctgcgtagtattggaatttcgccctaaactttccgaccttagtctagatgaagatgatgaagatgactgcctcatcttggagctgctgggcttttccgtggaatcgccgtaaggcttataattgaagtagtctgaatgcgacattatttgtgcctgtcaaatagtttacgcaaaggcttctcttctttttagtaatggcagactgtttgtacttgaaactgcccaatagtaacttgaaggacagacggagctcacacaaaagttaacaaatatgctggaacctttttttttcctttgaattctttgtaaaccagtaattcgttttgaaaacacccgttcttagctgttctttaacagtactactctctaaggcaataacacactggggcagcaacaattacaatcttctaacctcttctaatctgcagatttggcttctttctatctctgtttacccacctttatcactcttttcagattaatcaattctttccatacaaagaaacgcccgaaaagtggcgcgagtttcccgggtgatggagcagtaattaataatgcaaaactgctaaaatacccactgtttcagggtatgaaacgcggtattttcagcgagttgtaggtaatttggaacagttcgtgactgtttattaagttccactcattgcagttgtatccccactgtgtacttttatttttggttagagaattggcccagtagagatggaattggacgaatgtttagaaaggctatacaaggcccagttactacctgaagtgactgtaagggcactctgctttaagctgaaggaaatgctagtgaaggagtcaaacgtgattcacattcagacccctgtcacagtcgtgggggatatgcatggacagtttcacgatatgctggagatcttccaaataggcggccctgttcctgatacgaattatctgttcttgggcgactatgtagacagggggttgtacagtgtggaaacaattatgctattgattgtgcttaagcttcgatatcctagtagaattcatcttttgaggggaaaccacgagtcacgtcaaatcacgcagagctatggtttctacacggagtgcttgaacaagtacggtggcaattcaagagtttggcaatatttgacagatatatttgactatctagtgttatgctgtattatcgacgacgaaattttttgtgttcatggtgggctctcgcccaatgttcaaaccatagatcagatcaagattattgatagatttcgagaaattccacacgatggcgccatggcagacttggtttggtctgatccggaagaaaacaataaccccacgttagatcatccagataactctggacaacatttccaggtgtcacctcgtggagcaggttatactttcggaagaagcgtggtggagaaattcttacgtatgaacgatatgaacagaatatacagagcccatcagttatgtaacgaaggttaccagatatattttgatggattggttactactgtatggtcggcgccaaactattgttatcggtgcggcaataaagcatctattctggagctgtatagtaaagatcaattctacttcaacgttttcgaagaggcacctgaaaataaactgttgaaagagaacagtatgaacgacaatgccttagaagatagcatatctaatccggtagccaacaggaaattgattgcagattatttcgaagacgactctgcctccgcagatggctccacggaccctgaaatgtacatattttcagatgtataccaagccagatctgcttctaacagacatgttgattacttcttgtagcttactaaacaatagaaaagcattatagagacaacgccatcttattatttctacatattctatctctctcggttgcaaatgtatgtattgtgtatttagatcaaaaaaaaaaaaaaacagcgcattttctacaggtaatacagctccaaatttgtctgatcatgtacctcataatcttccagagagatatggtcttttaaaacacttccacccttctgcaacacaattttgtttggttgggtgccaatttgcaaggacaatacttttttgaaatcacctacactatcttcagcaaggcacttcactctgacttttttgcctaatcggtcattcacaactacctcaatcattttcagagtatttatttgcaatctaagctttgccaccgctcctctttctcaatcttttcctctccctcctcatctctctcagccaaaaccgcgaatatataaaaacaagcaagtctcccgtagaacttttacacgatgacctttcgagatttcacaagggggataaaggaatgctgtccgatacaattgacacaaagcaacaacagcaacagcttcatgtcctgttcatagactcttatgattcattcacctacaatgtagtgagactaattgaacaacaaactgatatctcaccgggagtcaacgccgtgcacgtgacgacggtacatagtgatacgttccaatctatggatcagctattgccacttttgccgctttttgatgctatcgttgttggcccaggacctgggaatcccaacaatggtgcacaagatatgggtataatatctgagcttttcgagaatgccaatggaaagttagatgaagttccaatattgggtatatgtcttgggttccaagcaatgtgcttggctcaaggtgctgatgtcagtgagctaaatactatcaagcatgggcaagtgtatgaaatgcatttaaacgatgcagccagagcttgtggccttttttctggttatcccgatacgttcaaatctacgaggtaccattcattgcatgtcaatgccgaaggcattgacacccttttgcccttatgcacaaccgaagatgagaacggtattcttttgatgagtgctcaaacgaaaaataagccatggtttggcgtacagtaccacccggagtcatgttgttcagaattgggggggctgttagtcagtaactttctcaagttgagtttcataaataacgtgaagacaggaaggtgggaaaagaagaaacttaatggagagttttccgatatcctatctcgattggataggactattgatagagaccccatatacaaggtaaaagagaaatatccgaagggcgaggacacaacttacgttaagcagttcgaggtctctgaagacccgaaattgacatttgaaatttgcaacatcatacgagaagaaaaatttgtcatgtcatcttctgtgattagtgaaaataggggtgaatggtctatcattgctttaccaaactccgcatcccaggtattcactcattatggagctatgaaaaagactacagttcattattggcaagatagtgaaattagttacaccttgttgaaaaagtgtctagatggtcaagattcggatttgcctggctcccttgaggtaatacatgaagataaatcccaattttggatcactttgggtaaatttatggagaataaaataatcgataaccacagagaaataccttttattggaggtcttgttggcattttaggttatgaaataggtcagtacattgcatgcggccgttgcaatgatgatgagaattcccttgttcccgacgccaaactagtttttatcaacaatagtatagtcattaatcacaagcaagggaagctttattgtatttctctggataatacatttccagtggcattagaacaatcattaagggacagttttgttagaaagaagaatattaagcaatccctgtcctggcccaagtatcttccagaggagatagacttcattataactatgcccgataaacttgactacgctaaggcgtttaagaaatgtcaggattatatgcataagggtgattcttatgaaatgtgtctcacaacgcaaaccaaagttgtaccatctgcggtgatagaaccctggaggattttccagaccttggtacaaagaaacccggctccattttcaagtttttttgagtttaaagacattattccccgccaagatgaaacgcctccagttttgtgcttcttaagtacttctccagaaaggtttttgaagtgggatgcagacacatgcgagctacgtcccatcaagggaactgtgaaaaaaggaccgcaaatgaacttggcaaaagccacacgaatcctgaagacaccaaaagaatttggtgagaacttaatgattttggacttaatcagaaatgacctttacgagttggttcctgacgttcgggtggaggagttcatgtccgtgcaagaatatgccaccgtttaccaactcgttagcgtcgtaaaggcacatggattgacctctgccagtaagaagacgagatattcaggcattgatgtccttaaacactcgcttcctccgggatctatgacgggagcccccaagaagattactgtgcaattattgcaggacaagatagaaagcaagctaaacaaacatgtcaatggtggagcacgtggtgtttacagcggtgtcacgggatattggtctgtgaattccaacggagattggtctgttaacattagatgtatgtattcctacaacggcggaaccagctggcaactcggtgcagggggggccataacagtcttaagcacactagatggcgaactagaggaaatgtacaacaagttggagagcaacttacaaattttcatgtagatatttgtatattattagatatgtatgcaaacattttctttagaataatatactattcttgtacgatgcagaattttttttttttttcgctttaggaaaatgacgttttgtgccgtggaaaaccctggaaaaggatattggaaaaaagttaaagcatggtcatttagggaagactttccttccaatttacttatcaataggttataatgtatgcttgacggagcagaattctttcaaaccataagataatagatattataacattttagtacataaaagaggcccgagaaaatagattttaactggaataattttttgcaagatgacaacaaccgtacctaaagtgtttgcattccatgaatttgcaggagtagctgaggcagttgccgatcatgttattcacgcacaaaactctgcccttaagaagggcaaagtctcaaggtccacacagatgtccggaacgagccttaacggaaatggtaacacagaatccaaaacgatggagagagtaaattctgtaaggagtaatgcctccagccgtggtggtagtgaagacggcgccactaagaaattgaaaaaggagaaagaaaggcgcttcaagattgcgttgtccggtggttcgttaatccaagtgttgcacgaaggattgttgaaaagagacgacgttcaatggggtaaatgggacatttactttgctgatgaaagactagtgccctttagctccagtgaaagcaattacggtcttgctaagagaaaaatattcgatttaatagatacggagaagtacggaactccgaaaatttatcacattgatgagtcattgattaacgaccctcaagagtgtgcagataactatgagaaaattctaattaaaggatttgccggtagagattctgtgaaactaccgatgtttgatctgtttctgcttggctgcgctcctgacggtcacatagcctcgttattccccaattttcaagagaatctacgtgaaaatctggcatgggtcatacctgtagaaaatgcacccagcggaccttcgaataggatttcactgaccatcccagtgatttgtcactctcatagagtcacctttgttgtagagggcgccacaaaggcgcctgtaatcaagacaataatggaaaggcctgaaaagggattgcctagtagtattgtcaatgagggcgccgccggtcgtgtttcatggtttgtagacgacgatgctttgaaagatgtctttgtaattaagaagaagtacaagttttatgatgatgagaatttgactgagtaggtgtttaattttttgggttctttttctttctgatgataatgacaactaatgacaatactatgatttaaccttaaccattttctttttttagctctttctatccccacccttccctttagtaatcgcaataaatcaccctatgtttttgaattttctcgagaagtaactttatataaaacaagtcatcttagtgacgtagtgtgcatatataacatacaacatatataatatatacaataaccctttagaaaaaaataataacaaccacagtggatatttcccttttggacctatggcttccgctaagagaaaagcatgcttttaagttttcttttctttcaaggagattatttggtcttaagcgaagtgagagattgaaacaaaatgttaattacagagtttacgaagaatcagtttgcaagaccaccttattcgtatggcattatcaagctttgtgtgtagactatccacacaaacatgattcaacatacatagcagtggtaggtatacaacggatataaaaaccttaactctacgtgtagaaaatgtaaaagggtagagcggttgcaaaaaagcaagttttagtaggattccaggaacagcttctcatcttgctagataacatacggcaataatgacaaaatacactgagccatgcggttgttacactttcccaaaatagtaatctacttctcccattttttatattttgcgtatcacaccacatcgtccctcaacacaaaagtttttgttcttgttgacaagactgtcattttccccttgagtgactttatgtcgctgattcattcatttcggcattgtttgctgtttattccccagattctttccgctttgcttggctgcccctttccccggaagcctcgagattaagatgaaaagactaatagccaggctgttaaccccttgttgatacagtttggacaccccctactagttagctgtgtatcctgaatctatgtcaagcaaaaattgcttacatacagtaaggtattttttataatcccgccaacactatgtcgactccttcattttggacatcttctttacatggacgaaccagagaaggaggtcggctcgaagggaatgtaaagctatcataggggtataaataagagacacattgttctattatagagaaaaatattttatagatcttgtatctcatcttgcgtaatataaccaaacaaaggttttccttatactatatcaaaccaaaaaaaaaaaaaagcaaaacaacaaataatcataatatcatgaagtcaagtattccaatcaccgaagtattgccaagagcagtgggttcgctaacattcgatgaaaattacaatttactggatacatcaggtgtcgcaaaagtcatcgaaaagtcaccaatcgcagaaataatcaggaaatcaaatgccgagttaggtaggctgggctactccgtctacgaagatgctcaatatataggtcatgccttcaagaaagctggccattttattgtgtacttcactccaaagaacaagaacagagagggcgttgttcctcctgtaggaataaccaattagctcagaacagaattagtgttaatagcggtgacagtagttttattgtatctcacctttttttatgtataatcatataatgacttaattatttttgaaatgtttctttttttttttttagttataaccctttttacggattcttacgtacttatttaatctttctagtagacaatctttctaccggtgaaggttcttcttgcctgttgtctgccttctgcactcaattcatcattttcatcatcttcgtccaccttggctctatttaagactttgatgaacgagtccactctgaatctcattctggagtgcatgtaggctttagagcactttatgtgataatggaagtagtttctaaacaatgttaactggcaaattgaatggaattgcaactcttttgtctggaaatgacgtgggaaaagaacaaacgtgataaatcttctactttgctctgcaactttaggtggttgatatagtctcttcaactccaatggtggttcatgtgagtataaaacttgtggagcggattggatttgacggtttctcttacgtgcatccacgaattcttgtaaaaagaccttgccaaaaattttatctgtttcgtcttgaaaaatagtctcgaagattatggtaactctgtcattggaaggtttgatgaagatgttctcctcgtcacgatacttgattgtgaacaaagtgttgtctccattggcagcaacctcaccgccagtaatttctgcttcgacaggtgccggttgctgctggcttagttcaataaacttcgaaatggccaattcgaagggaaaactcaatataatggtcttcaaaacagacagttgtaaaatcgattcttgaaccaattcggccaacgtaatctgaagagtgtagtcatagccgggctccacttcacttgggatagtcaccccacccaaagaggagtagtggtcggccagaaacttcagtaacgtcaaagaaccgtccaattggcactcagagacacttacccaagctttggtcttaacactcaacaacagaatggacttatcttctgctgtgtttgaaatgtggtaggtggtatagtcgaaatcggaaacaattctgtccatggtcaacggcgaacccttgcgaagtgcctctatcgcttcattcagtgtcttttggatgagaaggttttgtggttgtaagtgtagcattgcggattaccgttttgaggcaagaagattgctagtcttgtatctacactagttcctttgaacgctagttagcccctatgcttatagtatttcttgtcaatacaagcgtctgaaaattcagatcgctttatacgagtaagtatgccaaatacaccaaatataccaaagcattgattgcgtatactgagaatacatatatatatatatatatatatatatgtatggtcattgctatttacaaaaggttgtatggagtgggaatattagagaaaagtagtcgagaggccaaagaaaacttagagcgtactgcgcatcacgatttacttggcttcttggctccatatttcgacctcgaagaaatcctgtttaccacaccactcaggtcaccagcacctctgataacatggtacttcacaccaggcaagtcctgacaacgcccacctctgacatatacaatcgaatgctcttgagcatcgtggccctcacccggtatatatgcagataccacgttcccgttagtcaaacggaccctgcacgcctttctctgcgcagaattcggcttcttgggctttaaaaccattacacgtaatacgacacccttccgctggggacactgatccagttgtggagctgtacttatcttcttgcgtcttggaggcccggagcctcttttaatctgattcaatgtcgcttgcattgtcgtagtggaggaaaacaatctctgcgcctgtctcaagggcgtacaccatgtgttggacataaacctcgacaacatggctcttgttggcctgcttcaattctggtgtacctgtaagttctccgtcttttccctggttatatgcgttttttctccccaaatcgttttgtcgctcgggtaagactgaaatgcttttaaaagcactattactgtttattatgctatatatatatatatatacagcccgagtctggcttgatcttatttacatgatatatcatctagaaatctatatacactagatccctcatttgttcttggtttgagtatagctgaaacgcttcctggtaggtgcgaactcgcccagtttgtggcccaccatatcttctgatatttcaataggtacgtactccttaccattgtgtatttgaaatttcagtcccacgaactgaggaaggatggtggcggcccttgcgtttgttcttattggagtgcccttagtcatggcctcccttatgggtaatggcacgatgttggggcccttccatacggaccgcgataaaagtctagctgccggttgcattttatttttggtggacactacttctgccgatgctgtactgctcttgcaatgaacctcaccgttttaagtcatggttagattcttactaggcgcttccaattgccatttcttgctcagccataaccgtgaatagtgatccaaacgctaatgccgggtgatgcttaaaatttgaaaaattattgcagatttgtattatatagaaagcataactggcgatgagatgtgctcgaaactggacacctttaccattggtgaccggtagtgacaatgtttgcatcgagatttgaccctagccaattgactgctcctgcagctagcgcaccagaaggaatcgtcggaactactcccccggccattgtgcctttaaagaggcaggctactgaatctgataatgaagaatatggctctcaccaagattctgatgagagttccaactctagttcagaggaagacgaagaccgtatgcaagtagattatggggctagtgaagaggattcgagtgaagtggaagaggaagagagtaagccaagtactcacagcacagtgctatcgagattcaagcaaacagtatcattgcaagaaaggctaggtgcatctgatattgctgagagtaaggaagacgaaggtattgaagacgaggcggcctcaactcaccaactaaaacagattcctcaacctgaattcgtcaaaaacccaatgaatttgaatacaaattcattacagttcaaatctacgggttggttaaatactgagaagatatattatgataattccttgatcaaaccgttctcggattacgcaaatgaattagaagcaaaactactgcagaatatttgcaagaatttctctacaaacacttttcccatccaatcgatcatcctagactccatattaccggtattgaacttcacgttgaacgtatctaagagaaacttcaccagaagaatcggtgatattcttgtaaatgctgctaccggttcaggtaaaactttggcttactccattcctattgttcaaaccctcttcaagagacaaattaacagactgcgttgtataatcatcgtccccacaaaactattgataaaccaagtttatactacgttgacaaagctaactcaagggacgtcgcttattgtgagcattgccaaattagaaaattctttgaaggacgaacacaaaaaattatcaaatttggaaccagatatcttaatcactacacctggtagattagtagatcatctaaatatgaaatcgataaatttgaaaaacctaaagtttttgattatcgatgaggctgatcgtcttttgaaccagtccttccagggctggtgtccaaaactaatgtcccatttgaaaacggataaattagatacacttccagggaacgtgatcaaaatgatcttcagtgcgacattgactaccaacacagaaaagttaaacggcttgaacctttacaaaccaaagttgttcctgaagcaaaccgataaattgtaccagctacctaacaaattgaatgaatttaacatcaacattcccacggcgaaaagtgtttacaagccattgatattgttgtattcaatatgccaatttatggcacattcccccattgctgcaaagattttgattttcgttaaatcaaatgaatcgtctatcagattaagcaagttactacaacttatctgtgaatctcgctcacaatccagcgtattgaaaaaccttcaaaatttggcggtgagtattaattctgtcaattcaaacaactccaaagcagaaaataaaaaaattgttgcgaacttctcgcatcactcggaaagcgcaggcattaccatcttaattactaccgatatcatgtcccgtggtattgatattaacgatatcactcaagtaataaactatgacccaccaatgtcttctcaacaatatgtccatcgtgttggtagaacagcaagagctaacgaacttggttccgcttataacttactagtaggtagaggtgaaagaacgtttttcgatgacttaaacaaagatctagatagagacggtaaatctgtccagccattagaactcgattttaccctattggaatctgattctgaactatatacttcgtctctagaaagtttgaaaaactatcacaataacaccgcacaagcttaatttctcactttccaccttcgcatccattcatttataacattcaaacatttttttttttagtctcattctaataactcctgagtatagtaatattaatatgtatgtattgatgggtatgtaactgtaaaattatattcggtctatgtctattgtagtttcacacgttggaatgctcgtttgaatgcacttgtcaatggctaaccttaacatcaattcgtcatcgtcggagcctcctttcattgttatcttgatcagtaccacataaagcgtaaaattcactttgcttattactatatcatcgtaatttaggatgtatctggatttaaactcacttaatctctcgatttggtccttgatcatgttcttaatggttgttggattttcagtgaaacctgcagaattcaaaaacccagttttccgtatctttgtattctttgttgctataggtagtgagctcattgatcttggtcgtacagatggtttttctttagcagctttagactcgacttgttgagtatgggcggtcgtatcagtgctgtcattattattgaataacgctgaattggataaagatgtggtggaaaatcccattagtaacactgtcgaggtccaccgtgctatagtcagcccatgccatagaattaaactcgaaataaccaaagtagcaaggtaatcggatatactcgataacagatccaatagtaggggataaatgaataggtatgctgtataagtgatggtaataatcgggttcttcgtctttaaattactgtatttgttagcataaaacgtcttataaagtgataacgtcgataacactaaattgatcattagtatgctataccataaggtaatattctcgttttgtgaatcattggcattggcaatgtgggaatgaggaatttgctcattaatttcatcgtgatcatggttattcgtcaaagaactaccagattctacaaagaggactatgaattcttcaattatatggaataaaaggtccagcccaacaaagcataacgaaacggcaagcgcaaaacttagtagaacgtctattctatttaacccgaatggaaatgtgatagtgcctgtaaaccatacctggaactgagacaaattttccacaaatatgattaccagcgaaccgatgatatcgtaagtaataaaatgcgatagtgtaataaaattactccatgagtacaggtgtccgacttggaaagtaatcagacatgcaaagatttgtagagcggcaatagataactgaatataagcctttggccatggcaaatttgacagcaaatcattgaaatctggaatgggaagagatttggcaatgttcaaaggaattttcacctcaggctcttgaaaaaaattcatggatacagaggaatgcttataacgatgccccttacgaaatgaggtccttgatgcagctgaagagggtggtgtctgttgatgcggttgcagcgttgatgtcgtaaaattaaagggagaatccaaggtcatagaagacctcttactgctgccagcatcgggggaaatgcctcttaccggtgatcttgttctgggaggaggcggcaccagctttggtgctggtatatatttgagtgattgccttcgtccttcgttgccttttcccttcatcaaagcagcttcattgatattagcattactagaagcgttttcaccaaaagtgaacgaaggattgtagatgatactagaactggaattgttaccttccttggcagaataaaatagggaactgggcctaggtgatgcaaaaaatgtcctgttttgggatggtataccgtctacattcccgacagcgttcatattggacaaagaaaacgatgaagcatcggaatcattcaatttaggagtctggaaagcaacttccggagacaaattgtcctcctcttgtatagcgttcatttgcggcgtctccatagctctttccctattctataatctcgctcacaagtcactaaatattcactttttctctcttagtaacaaaaataccttcaaggttcatcattttcagtaatgaatattcttgatattacgcaataggacacttgtggaaaactttttgaggttgcgttacccgcgctgaaattcgagaacaataaagatcatcatctctcattttagctacattataacataagaaggtgcttttagttatcttatgtggactagggtatgacaaacatggctgccaagaatcagttcaaaggaagcagcttcacactagcgcagctaatcgaagaagtcggacgtaacggaggaaaaaagcctgtgttccagtataaggtaccacggtcgatacgatgggcttcaactgctctagctgtagtgtttctcacatatggcgctgcatacactgatatgtcgtggagaactgctcgagaagtgtacggaaacgctactgaggaagaaaaacacagcccgtggttcaagtgcaaaacttttgggcctgtggctttaggggttttgcctgtgatcctcgctgctgccacgaaacacgtaacgtcaagactagtcacagaaatgaaatatctgccaccgctcaagaatagtacggtgccacggtgtcaattgactcgacgcacttacttgttaggaagaccagtttctatcacgagggagatcaatgaactgtctaaaaataaggccaccaagatcttcacaggagtaggttctcaaggtatggaggataaggccacctttgttttcttcacagtggatgaaaaagcaccctcatttttcaataaattttacattttctcgagatctggtagcgttgtgaagaatgacgccaggatcttggactgctttttcaacagtgtggcagaaaataagctattgaacaggtcaatattaactcagatcctttcacatacgtctgccaagaccctatttcactcggggaattctagatcatccatcaagaatatcgtgaagcccaaataggtacggacatctacgtaagaatgcatgtaaataataatcgaataaaagaacaattaaacacttgtatatgcacgctatatctacaagaatccaaacagtctcaagatgtagtcgactgccaaggcgtacgtaaagtaaagtccggtgttgatatttgcattaaaatacttccagcagtttttaggattgtcaagatccactttctttatcatgctgaagagtctataagcgaagactcctagtccaccaatgaacccaggcccccataacaacccactgttcaagccggcgacagctaacagtgcgatttgagacgcggacatggccttcatgatagactttgtgcgtggaccccaagccaaagcggtagacttgattccagccttgatgtcaaactttttatcctggtgtgcgtatatagtatcgtaagtcatacaccacaagtaactgctcaggtacaaaggtatcattgtaggccagctcattacacccatggcaggaaacccaagtaacgctccccaattgaaacatgcacttaatgcagcttgaggatagtacgtaaaccgcttaaacaaagggtatgtgaacacaataggtaacgatgcaaggcctagccaccaacactgcgcaggaagcaaagatagaacgcccattccaacaagagtttgagcccccaagaatactaacgcccgacgggggctcactctaccagaggcgataggcctctcgacggacctgataactctttgatccaactttctatccaaaaaatcgttgatggtgcagccagcacctctcattaccaatgcacctacaccgaaaatacccaacataccagctgttgcgctcaatgtagcaccttgcatcatggctcccataagtatagaccaactgcagggcaaatataacagccacgtgcccacgggtttctctagcctcatcagctccgcatacggtatccatttcttaggcagccgagacacgaacggtcccagtccatccaatctttcctttcttgcaacttccaactctttcgacgtaaacacaggtgctgattctttcgaggaaggggaggaggaggaggaggaagaagacgtatatctctttctgctgcttccaatgattccagcaacggtaactcggccgctgcccagaatggacctccctagtaaaatactctttctctgccaaataaacattagttgacactgttattctacgacagttatttctactgtaatctatagtatactccgcccttctgataaccttacttttaattttggcctgattcttgtgaaacttttccacgatgccgaaatcgccgaaatggctcgtttagccttttctcgaagattgatatataaagagcatccatcgtgctggtaatggtgatgcaagattgaaaattcccagacagtgagcaccagcacaatgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataagatcaattcgatatgtaacatttttcttttcttttcttttcctttttttacaatagctaatttacgtttccctacggtattggtcggaacgaccaagcttcaatttataaatatcttaattttaacagcagttaccacttgaatgagaaactttttgatgcctactcttttgctttttcatatcatgacctccctacatgcttcggaatttccttattcgtagctgtctaacagcaccacttagcacaagtacgtccacccgtttcatacttaaagatctcagcagccacccaatctacatttagggtacctgtcacatatcttctcaaattttaggttagctttcaattgtaaagtctctttttggatattgcacgtttcaagtcaaaacgcggctgtaacataattttctgaaacaatattaaaacatagtaatgacttaaaacaagcgactatcgcaaataagcagttcccagcaagcaattaaaacgtatataagcgcagaataatgatctatcatcaataattatcgtgaacttttccagtatttacgttcatctttgaaaaacggcgagcattaacaataaaagctaaaaaaaccaaaaaatttcagatgacattatctttcgctcattttacctacctgttcacaatattgttgggattaactaatattgccttggcatctgatccagaaacgattctagtgacgataaccaagacaaacgatgcaaatggggttgttacaactacagtttcacccgcgctagtctccacatccactatcgttcaagctggcactacgacattgtatacgacttggtgtccattgacggtatccacttcatctgctgccgaaataagtccttcaatatcgtacgctactaccctatccagatttagtactttgacattatctacagaagtctgctcccatgaggcatgtccttcgtcatcgacgttgccaaccaccaccttatctgtgacttccaagttcacttcatatatttgccctacttgtcacacaaccgctatcagctcattatccgaagtaggaactacaaccgtggtatcatccagcgccattgaaccatcaagtgcctctataatctcacctgtcacctctacactttcgagtacaacatcgtccaatccaactactacctccctaagttcgacatctacatctccaagctctacatctacatctccaagctctacnnnnnnnnnnnnnnnnnnnnnnnnnnnnnnnnnnnnnnnnnnnnnnnnnnnnnnnnnnatctacatctccaagttcgacatccacatcttcaagtttgacatccacatcttcaagttctacatctacatcccaaagttctacatctacctcatcaagttcgacatctacatctccaagctctacatctacctcatcaagttcaacatctacatctccaagttctaaatctacttctgcaagctccacttccacttcttcatattcaacatctacatccccaagtttgacttcttcatctccaactttggcttccacttctccaagttcaacatctattagctctacttttactgattcaacttcatcccttggctcctctatagcatcttcatcaacgtctgtgtcattatacagcccatccacacctgtttactccgtcccttcgacttcgtcaaatgttgcaactccttctatgacttcttcaactgttgaaacaactgttagttcacaaagttcgtctgaatatatcaccaaatcctcaatttctactactatcccatcattttccatgtctacatatttcaccactgttagtggagtcactacaatgtatacgacatggtgtccttatagctctgaatctgagactagcacattaaccagtatgcatgaaacggttacaacagacgctacagtctgcactcacgagtcttgcatgccctcgcagacaacaagtttgattacatcttctataaaaatgtccactaaaaacgtcgcaacttctgtaagcacctcaacggttgaatcctcatatgcatgctccacatgtgctgaaacgtcacactcgtattcttccgtgcaaacagcttcatcaagttctgtaacacagcagaccacatccacaaagagttgggtaagttcaatgacaacttcggatgaagatttcaataagcacgctaccggtaagtatcatgtaacatcttcaggtacctcaaccatttcgactagtgtaagtgaagccacgagtacatcaagcattgactcagaatctcaagaacaatcatcacacttattatcgacatcggtcctttcatcctcctccttgtctgctacattatcctctgacagtactattttgctattcagttctgtatcatcactaagtgtcgaacagtcaccagttaccacacttcaaatttcttcaacatcagagattttacaacccacttcttccacagctattgctacaatatctgcctctacatcatcactttccgcaacatctatctctacaccatctacctctgtggaatcgactattgaatcttcatcattgactccgacggtatcttctattttcctctcatcatcatctgctccctcttctctacaaacatctgttaccactacagaagtttccactacttcaatctccatacaataccaaacttcatcaatggtaacaattagccaatatatgggcagtggatcgcaaacgcgtttgccattaggaaagttggtcttcgccatcatggcagttgcttgcaatgtaattttcagttaatatcagaacaatttaattcatttatataaacatatacaatcaatcgaataaaaatacaacaatgtaatgaaaacgctctctattgatatgtatttgctgacgcttataaatttattaaagttttattttaaaccgttctagtgacttcacgcggggagatacatccaatagtaaattacaaaataaggaaagtataaaacaaacggataacaacagtagcttggagacagcaaaggcacccgagcaggcgtggaaacacacgatgcatttgaaaaaggggaagaggagtattagcacagtatggcgacttttatggaagcgtttttattccgtaaactctaagacgaatatgcatttttctcgaagtaggaagaaaccagtgacaaacttcacaaggacaaacggacttctcctgagctgtaatggtgatacattcccatatctgcgtacactgtggagatacttcaatgcgcctggtaatttgatgtttgtcacaactaatattgtcgcatttatgggcattgttacgtataatacgctggttactatcagcagtgaaagagcattcgaagagcagatgatggcggcacaggtgagcctggcgaaacagagagaagagctcgagactacggccctcagcttgccacgagatattgaattgaggggtgaagaagatgatattaaatgggagcaacctgatgtagcacatgtccgggaagatcccttagtcgaggagcagaacgcaaagttagacacccctataaaacagtatactttaggagatttgattttgaataagagggaaaatgtcactgattatgactcgcagcgtgcgaaggcatctatattccacatgctatatgcttatatgctgtatcgagatgttattcaacccacgaccatgactcaaaataacaacagcgaggaatggcggcgtgaagtcgagcttttgactaagggaaaagaggtacaaggtactcatcgaaggatagacgtgttctacgacctgtggaataaaaatttcgataagatagtgacatcacctgagaaagtgcagaattttcaactgccgaactggtctaaatacccaacgatattgaaattcatctgcacagaacttcacgacaacagtttgaagaccttgggtgagtttaagcaattctatggaaaggtgcgatctaacgaggtaaaaaaactgttgggtctttggctgtacgaccattccttccttttcccccataatatctacgacaacagaaccgaagaagatttttacgatatattaattaatgactccatgcaggataacaggatattccagaaatactcttcaattgtaatgaatccctacaacgaacgtactcaactttttttccctaatgtaaattctccatctgtcaacaagccagtaccgagcatatctctggaaacatacacacgactactcaagggatatatcaacttgcaagaaacaggctgcaaatacgactataatgacaatatattcaaactaatcagcatcctcaaactaaattgtttcctacaacgcaacaagaagaaacacgcagggccaaccgtcagaatcctactgccgagagatgaagaccgctctcaaatacttggtaccatttcgcaggcagagaagagaacctgttatcaaattctaagcaaaaatagggacgtggttgcgctgctgaaacgcatttctgatatccaggcggactcttcttaataaaacatgtaaatatgtacctcccaaatcacactcatcatctcatacgaaactgtatctttttgggtaaaattttcatcgatgagctttaaaagcaaaactacttcaccagcaaagaagctactgtagcatcctatgatctcttcggctctacacatcatattactagcctagtcaacatgaagttcttaaccaccaacttcctaaagtgctccgttaaagcctgtgacaccagcaacgacaacttccccctacagtacgacggcagcaaatgccaattggtacaggatgaatctatcgagttcaatccagaattccttctgaacatagtcgaccgcgtagactggcctgcagtgctcacggttgctgccgaattgggaaacaacgccttacctcctaccaaaccatccttcccatcttcgatccaggagctcaccgatgacgacatggccatccttaatgacttgcatactttactgctacagacgtccattgccgaaggtgaaatgaagtgtaggaactgcggacatatctattacatcaagaacggcattccaaacttgctgttacctccacacctggtataaatcaagcgagatctctgtgtgtgggcacgcaagacgaaaagacaactatatacacagctatatatgtagtagtagcctcatatacgtatggcatcaaacatgtagcataaacaacctaaaaggaaaacaaagactgagatctaacccaccacagtttctatttgagccttcccgtcgcgcgtgatttggagatacagattctaagagctttaaagaacgagatactctcctgttttaaggactcaccggcatataaggcagcaaagtcgccggtttgaaggttcaggggccttgaaggtagtatcatttggaaaacagcaagagaatatggctggacaccatcacgaacatgaacaagagcgcgaccacgagcaagaacacgaacacgattcccttcaacggcctactactggatcagaaaggactagaagtatatccttttcgaagttgcttacgcggtcatggaaaaggaatgcgagttcatcgaacaacatgagtgtgtctagcgtgaatctgtattcggatccagagaactcgagagaatcagatcacaataatagtggctcagagggccagtcttcacgattttctaaattgaaaagtatgttccaatccggcaatagcagcaaaaatgccagtgcccataacagcagccaaagcagtcttgaaggtgactcggcgtcatcttcatctaagttaagatacgttaaaccaatgacttctgttgccaatgcttctccggcatctccaccactttctcccacgatcccggaaacggatgttcttcaaacaccaaagatggtacatatagatcaacatgaacatgagcgtgaacactcgaattgcgggtctccaataatgctttcatcatcctctttcagtcctactgttgccaggactgggacgggtaggagaagatcaccgtctactccgataatgcccagtcagaactcgaataactctagtagcacctctgctatcagaccaaataattatcgtcaccattcaggatctcaggggttttcttccaacaatccattcagagaaagggcaggtacggtacgcagtagtaacccatattttgcataccaaggtctaccaactcatgccatgtcttctcacgacctcgatgaaggattccaaccatatgcaaatggcagcggcattcactttttgtccacccccacctcgaagacaaattctttgacaaacaccaaaaatttaagtaatttatcactaaacgagattaaggaaaatgaagaagtgcaagaattcaataacgaggatttcttctttcacgatattccgaaagatttatcgctcaaagatacgctgaatggctcacccagtagaggtagttccaagagccccacgattactcaaacgttcccttcaatcattgtcggatttgacaatgagtacgaggaagataacaacaatgataaacatgatgaaaaggaagaacaacaaacgacaaccgacaataaaacgagaaatctttcacctaccaaacaaaatggtaaagctacccatccaaggataaaaatacctttaagaagagcagcttcagaaccaaacgggttgcaactcgcatctgccacatcgccgacatcttcttcagcaaggaaaacatcagggtccagtaatataaacgacaaaatcccaggccaatcagtgcctcctccaaactcatttttccctcaagaaccctctccaaagatttctgattttccagaacctaggaggtcccgacgtttgagaactaaatctttcagcaataaatttcaagatatcatggtgggaccacagtcttttgagaaaataagattgctgggccaaggtgatgtaggtaaagttttcttagtaagagagaaaaagacgaatagagtgtatgctttgaaagtcttgagtaaagacgaaatgataaaaagaaataaaatcaaacgtgttctgacagaacaagagattcttgccaccagcaatcatcccttcatcgtcacactataccattcgttccaatctgaagactatttgtatctctgtatggaatactgtatgggcggggagtttttcagagctttacaaacaaggaaaaccaaatgtatatgtgaagacgatgccaggttttatgccagtgaagtgacagcagcactagaatatttacatctgttgggttttatctatagagatttaaaaccagagaatattttgctgcatcaatcaggccatatcatgctttctgacttcgacttgtctattcaggctaaagattccaaggttcctgttgtcaagggttccgctcaatcaacccttgttgataccaaaatatgctcagatgggtttagaaccaattcctttgtcggaactgaagaatatattgcccctgaagtcataagaggtaatggccacaccgctgcggtcgattggtggacgctagggattttgatctatgaaatgttatttggtttcactccattcaaaggcgataacacaaatgaaacttttacgaatattttgaaaaatgaggtcagttttcccaataacaatgaaatctccagaacttgtaaggatttgatcaaaaaattactgacaaaaaatgaatctaaaagactgggttgcaaaatgggcgctgccgacgtgaagaaacacccctttttcaagaaagtccaatggtctttgctgagaaatcaagaaccgcctctgataccagtgttatctgaggatggatatgattttgctaaattatcatctaataagaagagacagactagtcaagacagccataaacatctcgatgagcaagagaaaaatatgtttgaagaacgagttgaatacgacgatgaagtctctgaagatgatccattccatgacttcaattcaatgagtttgatggaacaggataacaattcaatgatttatggtaataccaattcttatgggaaaattgcatacactccaaactccaacagatcgaggagtaatagtcatcgaaccttttttaagagataaagggggctttgacgtataagtgtcggttattttttttttttatttgattttttttctactcttattttttccctcatttattcatcatacatttaacgaactctatttcttttcaaaatccttatctacctatttttttttctttattttctttcctctgtcagttagtcagtagtgtgtaacttaaataaatcatatatcggtgtttcaatttctagcattctgtgtaaacatcagatgaagcattgcctttcttttcaatgaactctatgtagttttttcgatttgcttgcgtactatttttcacgcgatagttgaagaaacgatagaaggatggcgcaatatacaagttaaaagcaaatagatatctaatcaatagttaacatctagaataaagtgctggaacttagatttttttgtgcaatatgggactgatattaaggtggaaagagaaaaaacagttgtctagtaagcaaaatgctcaaaaatccaggaaaccggcaaacacatcgtttagacaacagcgcctcaaagcctggcagcccatcttgtcgccacagagcgtactgccgttgcttattttgatggcatgcgtcttcgcacccattggtatagggctggtggtcagcacgataagtgtccaaagactagtggtaaactacacagaatgtgatgcattggcaccggcgaagcattttgaaacgattccctccgagtacgtggactaccacttcagtaagaaagtcgcagtccaacctcaatggatggtacttacggatcctgaattaggcaatcaaacttgtcgaatacagttcgaagttccaaatcatatcaagaaatctacttatgtttattaccgcctaacaaatttcaatcaaaactatagagaatatgtgcaatctcttgacctagaccaattaaaaggaaaagcattgatcggaaatgatctggatccaaactgtgaccctttaaggacggtagaaaataagaccatattcccctgtggattgatagcaaattcgatgttcaatgatacattcggcacaacacttactggtgtaaacgatactgcagattatttgcttaccacaaaaggtattgcgtgggacaccgacagccacagatatggaaagaccgaatacaatgcatccgatatcgtaccgcccccaaattgggccaagttatttcccaatggctacactgacgataacattccagacctacaaaactgggaacagttcaaaatatggatgagaactgctgcattgcccaacttctataagctagcaatgaaaaatgagaccaatgggttaggtaagggtatttacattgctgatatagaactcaactacccagtaagatctttctatggaacaaaatcttttgtattaaccacaaacagtattatcggtgctggaaacgaggcattagggattgtttatttgattgttgccgggattgcaactcttttcgccatactattcctgataaaagtcatcttcaaaccaagacctatgcatgatcatagctacctaaattttgagaacagcgataccccattcgatgagagtagtgtcgttagtattccattgagagaaattttatgattgattatcatttactataaaatccctgcgtttgattcggtctctagggaagcgttgtaatttcatgtatattcaaaataaggacgaggttatataccatactatattatctccttgcattctgtatcaaacactttattcagtacatatacgatacctatatattcattaaatgttcttttcgctttatttcagcaaggtatagtgctatttaaaatccataatcgttattgcgtctctttagtctgtccttcattgccattactccactacttgcgtctggtggcggcgttggcgtgctggaggtgttgaaactgttcgacgttttacttcgaccgagacttgccctgaattcttggcctgctgaaggtctagtcggccgtgatgaagctcttctcggtgtcgcgctagaggagcttgtatgattattgtatatatcttgaaacgatttactcgcaggcgtgtactccggtgtgttcccgtttgaagaaggtgtacccataggatcttctgaagaagccttccttctgttagaaaaggatggcgagaaatgacgcgagttttgcttcttcatatcatgcttcacttgagtatctaatattttacgttcgttcggtaaatcttccttctcccccaaccatcctgggaacccctggaaaggatgctgattttcatagaatttcacaagccctttatggaccaatgtagtatttacagtatcaccatctttttctgctttaatggataaatgtgccaacgatgtagataacgatttggttgacgacttaaacttgttccaaaatcgcccggatccttcttgggaatgcgatacttgactcatcatatgcgtgaaatcttagttatactggtagttggtattagggcctagcgtctaatagttagttggcgttttatttttttgcacctttcctaatagtattaatctctaaaagtgaaaaactcctaagagtctttacgagctcatttaatacgttctgatcagaagcaagactataaaatgcaatagccaatactttttagactaaaggtagacgacttactagcggttcaagcttcaggaactacactctcaattacgttctagtccattttgtccctctttccggttttttttttttacgtttccttatgaaagtataagtaatactaaagaaagatttataaagtgccgttactgttacgtatgataaaccttttgatacatttcttcttatttaagccactgtcttttcctttagatagatgccgtacttgtcctttagttctttcatgattggatcattaatctctggtgagtatggcgctagtaagcctggtcccttgattgtaccatctaagacgaatttcgttgcaatggcaactggataaccaacagtagcggccatagaactgtaaccaccaaccttaccatagtcaactaaagtggatgttcttgtttcggtagttccatcagcccattcaataccgaatttgtgttgtagtacaaccatatctctttcattgtcttcatattgcattagttcttctaaacgtgcacatagagtgtctaaagcattacctcttggtgtgatctttgcgtcagagaacaagcctaaccaagcaaacccggaaaggattctttctctatcttcatcatctttccaagtagcctttgagtcaatggaagcaatcaaatcttctttagaagtagacttggcacctaaatattgttttagtgcttcgttccaggcaattggcttgctgaagatttcgttagcatcatccttcaacatacccatgtcaactaaagccttaacaaattctgggaaaccttgatatctcaaagtacctctaatgaccgtttcggcttctggaatatgataaagatccttgaaaagggtagagtctctatttgggtagcaaacgaatgcataacctgggtagatgaagtaaggcttagcagtggccattaagtcttcggaagaaacagtttcaatctttccgtctttccagtatttagcagagtttcttaaagccagtagcacacctctggaggaccatgaaaatttgtatcctaatggattatcagagtcttcaggagctggtaaaccaccacagtatgacaagaatgactttagcttaccaccagctctgtgaacttcatcaatagtcttgaccgcatacaagtggtcgatacctggatccaacccaatttcgttcataactgtaatacctgcctttacgatttctggttccaattctcttaaggcaggtgagatgtaagaggaagtgacgacatcggtctttgttctgatggcgctctttaccacatttggatggaaggtgtatggaatcaaagagatgacaacatcgttatcagccagaactttgtctaaggcactgtcatcggtaacatccaatgaaatagccttggatccagagggcttggccaatgcttgcgcattggctaatgttctacatgcgacagtgacattgatgtcatcattagcagccaatgtgtcgataacaggttgtgcaacaaaaccagatcctagcaacaaaacgttctttcccatattaaaatatataatacgttaatataactcaattgtcctgataagttttccctactgcctaaggatccttcccatgtaattttaccaggaccctacggtttatataccattaagccaaattctgtgctactttctatcatctattgctgataattccattggaaattctcaataccctttattgacatctttatttttcactacaaagcgaatttttccaacggaatttcgattccagagtatgagtaattcttttcactactaaacgcattgcttcgtggtcagtagtaaccgcaatcacactcttcacttctgttgtggtgaatatcaaaagaaacaagagatcatccacaatttcctcagcttgacttgtctgcagttgcgattaaaatttgacttttgctccaccgctctctacaggtattatatttggaaatcatcaaatgatgggaatcccctacgtggcacttagatacgatacataagactcttgcatatgtagctaccaacgtgggaaaacctttcaagtaacagtttgtttgctcttagcaacttctagccctaatgaaaaaaaatgaaaaataattgccagcttttccccgcgacttttcaaaatcggtataaaagcaagtcgaaaatcagtcaaaaaacttttctctcttgattgcttattgcaatctcacttgttttttccttgattttactttcaatttagtttacaatatcatgggactttatctccatgactatgccatttctaggtagcctatggtaaacgaatcccgtagattattcacacgtttgttgtctttgttgacaacaacacagagtaagaaaaagcaaaagatttatctcttttgtccatcttttttttattttgaaggcgtgtaacatttattggttacaacatggcttgttttcttgtccctaacaatcgccaggagaattttttttgaaaattttcttctattttaattatgtacataaatgtcgtcagttaactacaaatgagctatctatcaatatgctttttttttttaattactgctcaagcttgctatccccttctacctccgtttcctagcacagaagaaagtgcccatatatcattatattcaatttttaacttgtctctttttcttttctgcctcggtttcgcgcatctactctacgctatattttcataatcatctcatttaaatggcattcattcccttccgcgccagtatattagttactaatcatacagtttcttgtttcaattttttagattttaattagcggtttttttttggtttttcttaagattggttttatgtattttttttttctttttcaaatttttttattattttttcaatttttctttttaaaaggcttgtggttgactagtcctttctttttaggggttgctttctatgagaacgtgttccattagtaaatatgccaggaggattattgctcgtgggcttctttactgtttttctttctaagcatacttcaataccatcaattgactttttcttcttctctaaagcatcgatttggctcttttgagtttcaaagtcgacgacggcaaaattgtctgcagctgttatcctcataactttaccgaattctttttctaaggcacttctcaatttttcttctcttaagccatttgtacctctaatgtagattggataaaagccgtccttgttaacggtgctgaatactggttttttcttatttttgctgttagcactagcgttgtccctccgattccccatttcaaattttctttcagtcggtttcttgggtagtgtttcaggtctgatgtattcaaccgtggtattatttttgctaattctgtcggagttttcattcatcaactttgaggcccatgtcatctttggtggattcgcaacgggctctggagaagatgaaggtgttgaagcgttattgccggattctttggcgtcggaaacctgtggctctattggtttaatttcagtttcagcttcctttacgcccccaggtaccggtttttcatcactaacttctttaccgttgggcaaagaagagttattaacagcatttatggcctcaacagagccttcctttgtcttgattggtgcagctttcttttcggctttgtgagatttttcatttagtttagtaacgtttcctaactcttctgtagagacctcatcttgtttgtggttgcccttagtactagatggtaccgtttcggtgtgaatcttggactctttagtgacgggtatagcccgaggttgactatgatcgacaattggtttttcctgagttgacgattcagttggcgcagttgtgtctttgaccgtttcctttttggcctttggtttcgatatttctggtgatttttctttttctttttctttttcaactccggactcatgccttattttatcttcttcaactgcactgacagagttctcctcgttagattgtgacaaagaagcatctgttaagacataaggcttgaatgaattggaaataaatctgattatatcattggtaatgtcaaacgtagacccattgctggatggtagcaggataaatgtttgacaaaacttatagaccggagttcctgtccaaaacatttcacccgtggccatgatcagaatgcttttgtgcaagtgcccagtgtactggaaatctatagtatctaattttagtttcaagctcctaactttggcatcatttctagaaaaaaacttattaatgttttcacgtccagtaactttcaccgttggaagaacgtcatctttttcgtttgttgacttggactgataattagtatgcgtcaactcggctgtacttgcataaaaatatgccaatttggaagggtcggtcctcattctttcgtagtagttttgcaaaaaggcaaaacatatgtcttgaacggtaacacccattttcttttatttgatacttctattcgagggtatgacttcaaatgcaactattagtgacaaggtaataaaactataacacacttgaaaaaaaaaatgcgatggttttgtagtattcttcgtgatctttttctctttaaaaatcaacgaaaaataaagatgtatcagtaaaataagttttcaacagattctctgtaaaatgattgactaattgaatatttgaaagaaaatgaggtttgaacgaaaataataaaacaaaaaaaaaaatgtaattaaatgggcaaaaatgaattaaaatgtagggaaaaaacacaacttgaagaattaaacagagtaaaaaaacgaaagcttgtggtaggtgatataaataaattaaagcaatatcttactgtttattcttcctctagaatagttttggtactaacggtaactagaaaactgaagaagtttttcgtattcttctaatactcaagcaaaatatcctatgtcaagtactaccacttgtacagtcttcgttttgtacaaattaggtatgaattgctcttttttgaaacagtaatgggataaaaaacaaatgacttagtttaacgtccgccggttgcgatagaacttttaaccgtaacaatagtaacagtggacaggaaaaaaaaacggtacgaaaaggtaatattgcctaatctgaaataatgtagtcactctagaactattaataaagaagcttgtacttcctcttatccctggaatggacggttatgctgcttgcaatatgtcattctttcattaatcgccacctgatgtttttcgctgctttggacgaaaaaatttccaagaaaaaataaatggttaaacaaactacagcgcacgtgaccgataactatacgggaataacgcatcaatctcctgtggaagagtgcttattgcatcgaagaaccaatctgtattactacatgtccaatcataagctgatgttgcttttaaactttttttttaaaattgtgtatacatatagtacataaatgatcattggtccccatcaataccgtatatgacaccttggtacttggcgaaatccgtaccgtttgggaacttatgcatagacagcttgctcaattggcagaaggatagaagcatcaatagactctggccgcctgtagtagtaaatatagagaatcttggtagccctaactcatcggcaagtgtggttagtgaatattgctgctgctgttgctgttgtgaagattgttgcaattgagggttcttgaactcctggattattttatacaccaggtttaagtcgtagaaattgggcatgtattgatggacccaccactcgaaatcctccttgttgttgggcatggagtcattcattagaatgttgatcaggaaacctagatcatatgccgcatggtatgtgatccaagtaacagaatcatccatcattaaaccagagtccattagaagctgcgaaaattcaaatacatcgatgcctaaattttcgtgtttttcgaagttgatacctgattttctgagtaattctaacgattctgtggacatgatttccttctttgggtcaaattcaaaattgaactgccacgttgagggaccgttgtcaggcttattgccgttggcgtcactcaaggaaagaccaagttgtattgggtttaagaagtctacgttggccctcattgtctgatagtggtaatcgaccttcgacctgaaagtgccgatcggcctagccaaagtccccacaaactcagtactgattgacacatgattatactgcgagaccagttgtcttataacggcgaattcactgtaaaggttggacttccagacatcgcgaacgaaaagataatttgggggtggtaaaaagatcggtggcatactttggttggttaaatgcttgggtagctgggaagccaagggacgattgagtcccactccctgctgctgttgctgctgttgttgttgctgcagaacgttcagtccgggcggcaaactagccaccgaaacaggcgttcctatattaaatggctgctgttgttgttgctgttgctgttgttgctgagttaacagtggctcgttcttctgcttcaaaagataggcattgttcatctcctgattaacagagccattaattgtatttacaggcatcccttgaggaaacattcttgctctattaacctttggcgaatacacctgaggtcccatgttttgctgctggtgttgttcagaagcctgcctctgagagaaaaactgctcacctcctacagctaataccctcggttgtacattcatagattgcataatcctttttgaccctttataaatgtataaaattgagttgcctgtttctaatcgttcgaagtatttccagtatgaaaaacaaggaagccctgataacgagacacgctaataaacttcaaactgatctttcttgtcagttatcattctactactataattgaaaagactcaataaagaaaatatcataatgatgaaaaaagagcgagcagcgggtaaggaccgaattccgtttggaatgactggtataatgagatttaccttatactatagagagggctatatcattaccgaacttaagttttctattggaatattatactttataaactaaataattacccatctatgttgtttccccaagaatgtttgctgccatataataagaacaaaaaaaaaataacaaaaaaaagaaaaaaaaatcacttgtaatcttaaattaatattatacaccggttgtccgtttttacctctatgccgtcttctcaacttctttcttctttggtttttcttccccttccttttcaggtggaaggacgaaccaagggattttacctctattaaaatcattcaatatttgcttagaaacaccagactcatcaggctcaccacccttcagtaatctaccttgtttccttgccagaatttcaataaactccgtggcatccttccatcctgagatctcgtaagttctttccaagtgctttacctgacaacgttttaaaacacctggaatatattgttctgggtgtgtgacgtgttcgactctgacaacacctctgaataaaatgtcttcttcggagtctttactagaaggcggcacaatacctggacaatcaatcaaaaaaattcttttcataagagtaatatattgccagaccttagtttcaccagggattggtgcaacttgacacacctttttctttctcaatgtgttaatgatggacgatttaccagtgtttggatagccgataaaccctacagatatttgctttctatcagtatgcaactgtgagaactgacgtagcaactgaattaacgaacctttaccgaaagagttggtaatagatgcgtgaaacgccaaagttggacgttcctttgacaaatgtttgacccaagctgcctacttgtaaagttagaattgaaaaaaaaaccttctgttagtaaaaaatacattttgtttcataataggtaatcttttgccccaagagaatgtaataatcattgttatagccgagattgattgtttcgaagagtggattaaactaaaaaaaaaaaaagtaagaaaattgtgaggatctttactacgaacatattgtatggagcccgagataaagtctcaaataacaaaagctcaactcataagatcctcgctgttctaaaaagcgaaggtatacctttaaaacaaaggttgtccttctaatttacccatgaggcttccccagaacggggaaatatggataagcgaacagtattactcttccaaaacagtaacagacacttctgtagataagtttatcctaaaacggatagagaagcaccctgacaaaaaggtttggtaataaaaatcatactctatcgaaaaaaaaaatctctcgtgctatcctcttggttggaaagaatacaaaaaaaaaaaaaaagttaacatactgcaacccaggtaggtaccaaatcacacttattaagaacataaattaaatgcttgtgtggtgtttccttcttcatatactcttccacggacttacaacgggtacccaatggatcccttgcatctagaacatgtattaccacgtcagacgaatcgatgactttatataattcgttccaaatacgtttggattgacccttactgaaaatagcttcttttgctgcggaggtccacccattttctttgtcttcctggttccccattagtcctaatgtggcatctaagacttgcttttcctcatacttggtaatgtcttcatttgtagccttgaccaagtcctctagattggatgcagcaagacgtggtctctttctttgggctttgggcccaaacgcatcagcataactttcggtatccaaaattctggcttttggggattcatctgcgtccttttcttccaacaatgacatgggaagcttatttcttctcagaagaacttgatatgtatctttttgggtttcacccaatgcacttctgaaatgctgcagtgcgtcctgagatatcactcttgtgttaccgaaccaacgacgatctggttggaccctcgcatccggtattgtggagtcctggaaagaagcggccctaattaaattacctttcttattcctgatctccttcccactagtgtacatattcaggaatttgactctcttggagtctctgtagaaattttcacccttcacacgaagattaccatctttggtgtcaccttcacgaatacgtctagatttctctttcttaccagtacccattgtattattcctcccctgatatttagtggttttgctgcaagtcaacagatcttcaaagttaacacttaagggaaagtactaacaagtagtaaatatcttttatatattctacgcttctttatatgcccaaaaagaagaaaagtgaaaaatttttcttcaagcgaaaaatttttgcgatgagcatcgggcaaaaaaacgtgctaaatgacaggttgtgtttatatatttgttattgattctatattatagtaaattggtgagaacattacccaagtctttggacccagaggattgctgcttgatatcagagggagcattggcacggcttgtttccacacgacgttgtttaaattccctgtgagggtgagaatctgcagactctccttcttttccggcgcgcttcctagagttcttaatgttttgtatcatcttactttgctccacgtttctaatgaattccgcgttcagtttgttggcctgcgagatttccatctccaacttggcctgtctgatatcgttctcgcgggcaatctgttcagtcaaatctgcccatttgaaacctgggaggtacttcacgttcaggatatcatcatggtagaaagtacctttcttgccaccaataatgttcccgttcaacgtctccgcacacaatttggcgtctcttttcctaataaactcggcccaaccttcttcatacttgtttttcttgtttcctccacctttaactctttgcttgtacttttgatcgtcctctttctttagaaatagtctatctacctcaccaaaacgagttaatatttgtctcatttttgcaggtttcatgtaaggtggaatactggagaagtataccaccccagtcttgtgtttagacttcttggcggcctttgattttaccagttgccttagtttttctgtttttaaatccagtgaagtggtggacgaagcttgttcttctacttctcgatcgagcttttctccattctctttatctggttgttctacatcctctttttcttcttgtttttgctcttcttctatgtctgactcgttttcactttcgatgtcttctaccttcttactgaagatatcatccttactagaaatttttttcttggtctgaattaagacgttatgttgatcggtttcctcatctgaggaaaagtcttcaaagtcactatttactttttcactcatgcgtaaaaatttacttcactctgctgcagtaaactgtttgctttgtacttacatagcaatgggtagtttgtcaggttgaaatttttcaaaatcttaatagcgaaagttttactgcgcaatgtgagaaaagctggctataacgaagtaattcaaaataataaaacaagagaaagaaaaaatttacacgtcattgcctttggaaatgtgatcagacagacccaatatcaccgtttaaatattcttcacgagataatgtagtttgtcaattgaaacgctatttggtggctggctaatcaaatatggtcgatgaaggggttgtcaatccagcagcccttaaagaattgtcgctatctgtttgttcctataattaatttgcactgaaaagatacatgtgcattattgcagtatattataaggaattccggagttttctagtaactttctagtcgcgcaaccgagagatgagtactacaacgcaacctatttggtagtgcatcctacacattgtgaacgtttttggttcatattacaatattacgatattacgaattttaccctttctttaatactaactttgatcagaaagcacctttatcaatatggccacgtctgggaagtcggtcataatcaaaaggctacaggctttggggtttgaaatatcaatatacgaattgtgagactttgttttatcttagggacgaaaatggatgtgtgaaattacttatggaaggatcaataatagcaacgtttgctaatgtgttaagatggcaaaatgctactggtacgcctcgttgagtatccatcattattaatagcgccaaaattgaaacattaattgcggttttagaacaactttagaattacagagcaaggtgataagatctcaatagcttatgaaaaataataattttttagaacctaatgaacgtgtcgaaactttccgcaaaatattatgtacatctctactcaaccttctattaggatcatgagaaatgtgttaaaacagaaaaaatgcaccctcataataaaaaacttggccaaaccaaaccctttctagtacatcgatatgtatatcacacaataaagtcaatgcagcataacttagaatcgaggtagcgactccccgtattgctcaaaatggaaaattctatggaaatagaattcatatgactctgagaactaaaggaacattatgacgaacaaaattgctatgatgtgaggaataagatgatacagtcctaccaaataccaaagatcgggtcgtcgagggcggtatcatatctagggagatttcttttcaattagagcatattcattatcaagtaaccaccatttgtattttttttttcttctcaaggtagttattctgttctgacgtgcagaagatgggcgtagcattgacacaaagattcagtgggaaactatatatccatatctcatcctggtttggaaaatgaagagctgcatacttatatgagggaaagaaggctaaacaaaatatacgtaaagcaactatcaagagccaatggaatctattttcaaaatttgcgttcttccaaaacatttatcccgtttgatgcattaatgaaaattatgaacatttatttccttaccacacgtacattgggtgctctactttcttttttatttaagcatataaaatgtacacagtagtaaaataccattttaaaatattatttgaacaatcatagaacactacgcaggtattcttcttcaaaaagatagcttcaatgtatttcatgtatctgaaaacgctttgtcttgccattaaagatctggtggccccgacaaaataaaaaaaaatactgaaggatgcgaggttcgaactcgcgcggacaaccgtccaacagatcttaagtctgccgccttagaccactcggccaaccctccaaagatttatactttttgttgtatctcaaaatgagatacgtcagtatgacattttgagatcctaaacgttcataaaacacatatgaaacaaccttataacaaaacgaacaacatgagacaaaacccgtccttccctagctgaactacccaaaagtataaatgcctgaacaattagtttagatccgagattccgcgcttccaccacttagcatgattcatattttatataatatataagataagtaacattccgtgaattaatctgataaactgttttgacaactggttacttccctaagactgtttatattaggattgtcaagacactccggtattactcgagcccgtaatacaacactttttatcgtatttcaggtagtataccacatcattatttgaagagtgggtgagttttgagataattgttgggattccattgtgattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattattgtactcagcaattgttgcgaaacagacaagattaagtatattattcaaggccttgcttacctagatgaaccattgagaaatatacatattgagcaatacctctaggtccgaagttccgtgcctacaccctttagtcagatttagattatatgagataagtggtattttgtggaccaagtttgtgattaatctgatatcaagttactttcttaacgacattaggacgccagggtagccagtattattcaagtccatagaacagcctgtataccttcacttcattaggtatattcttggttatgcgttatttaaatcctcatctgccgctgcttaaaaaaagcagctaaagtgttgcgtaggcacttcgaacaagtagtcagtaatatcaccttttaacatctaatcatcaaaagagacattttttgggattaattgtttataaaagctatgaacttaggtctacagaatgtaccaaaagttatcctgtaggatataggaatctacgaaaggggcccgatacttctatataatatatatttttatttctccttcaattttatacgttgtcattccttatcctattacttcatcaattcttgcaattcaacatccaataactttgataactgtttcccatcaattatgtcgtcattttacactgtatatgatacaagtagtatgagtacacaccaatagatgattaattttttccgacaatcaaatattgggatcataaacacacataatcgccatatccgttaattcgggtttcaatcacttcgtttgtctatcgtatcgcagcctagtgaatatttaattctttcaataaaaaaggcttaaaatcaccatgaaaatcacaagaggaatctttcaacaagaacaatagtatacaatccatgaatgaaggagttcatatttgactagaactatacaaaggttttgtactgtttttactgtgagggtagcatctcatttatccagaatctcagaagggagaaacccaatcgctaaatcgatattatcacccagaagtttcaaataggcgattgtagaatatacacagggacaaccactcagtttatggcttcagtgcgcgcccagttctggaggaaagcattatcgaagtaataaaactttaaaaaagctctccgcaactaatgaggattgcagtatccagatacccttgttttctgccaaatgaacacttttactatgtcatataaacaaaaagtgccatttcttggtactgcttcagtcttaggaatggtcaatacgttattattacttaaatatacgattaataacatgctctgttgcgtatttagtaagtgtgtaaggaaactgtaatattacctaaccggtatcccacgtgtttcacgaagggcgcttttgttgttgcaattataatcctagttaggtaaaaaaaaaatacttaattcctatcatctactagatacaagaaagacgtctctgaattacacaccgtctctcaaattgacagattgcaaataccatctcttagtccaaagtcttatcctcttaccatagtagtacattggtaaagcaaatgcagtaatcccaaagttgatgacagctaaagcaatgtaagtattttcagtaccagatgcagctagccaatcagaacaggtaaaggtgaaaatgcaagatatcgtgttgttaataatagcagtacaaaccataccttccaaaaccatatcggggtaacaatccattaaatacgccatcgcaatatcaccagaacaaccccatgcaaacccaacaaaacccaacccgacgtatatagcttgccaaggccattgtctagcggtaccgataccaaacatcagcaaacccgctggcccaataattgcagttgcgatagagaagtatagtctaaattctgcctctaaaattcctctattgtgacgagccatccaaagaacaaagtagtcactaacaatgccagcacagatacaaccgatgactgctccaataagtgtgggaacattcataattgcgacaccaaaatcactatagttccatggaggttcgtagtaggcgctttcttgagtggtcaaataaaacgtcaggaaaacgtcttgaataccccaaaacataccagacaaccacactggcgggaataagaacattctaaggttgatctttagatatttgaaatactgtttaaaaccgtagcctttcaaattagtagctttggttaatattgctactctttttgggtatggtttcaaatgctcttttgaaccatcaatcaattcgcgagtctcaggtatggtaacttcctcttcattgttaacttcgaattcagccgtctctgaaaggtctacacctttctcacccatggctccaggagttgataatttagcgtcaagatgacgtttcctgcgcgacacggccgtattgtcagagttttgtaaagtggtaccgtcttcgtatcccgattgacagctggtcaaaggggtcatatactggcctctgtcgaagtacgtttcttcgcagccaaatataatagttattaaaaggccaccagatatgatcactgcgacccaaccgacccaacggaagttggtaaatgcagatatgtacccagcgatcaatgggcccaagaacgtaccgatactagtgcacatgatatacacggtcaatacggagcccaattggtgctggaaaaaaatgtcgctcagggacagttgcacctgggcttcagcacaggactcactaatacctacaaacaactgagaccatattgtgtcgctcgttcttttggccaaagcaaaccaaagcgcaccaaagagacctaatgtggtgcaaactatgtacgtaatcttcctgccatacaagttagcaaatggagccaagaataaagtggaccaaccaatacctaggaaaagaacaccagcccctgtgttcatggaatcgtaggatatcccataaatctcattcaatgagtcttgagcagcaccagcgtcgttactagtagcggcggtaaacgcagttataaaggccattagaccaaaatgagccaatttcctccagctagaccagttcagtggatcatttggcgagtatgatggttgagggattaggacgactcctgaggaggttttcttcaattttgattcgtatataataccattttccaaattttgggaagaatagatgttaaatgtgccaggaatatagtccggatgatccctgttggtatatttgtccatctgttaaaaatttaagattcacactcgcaaactttcttctatagtagttcttttctttatattcgttagaaatgcaaaagttgcgaagctgttttgttatatcctgtagattgtaatatgatacttcgattctttcggatttagtgtttacttgctattcttctagtttcaaataaataagataataagggatgtcaacttggtagtaatagcatgaaatagtatcgtaaaattaaggatgctagcgctttcgacaacaaaatgggcttgttttatttttgcagaggaggttcagtaaatattacctcagagactgatacagataattctttcttattcgactgcgtatttatctttatcgtttagattgaagacaatagacaattaaatgaatctatagaaaggttaggaaatagtctaaactactatggtttgttaacggcgaggtctttagtttaattttctgtctggaaaataactttatcctaaaaagaaaattttcatcaactgcaactttttttgttatgcttttgttctcgctaggcgaaagctccctaaaaatatccgtagaatttcatatgacacaaccaggccttgatgtaaacgtcaaactacacatttctcaaagcttagagagctgatgcatgaaatttttgcattgtgtggtattatatgtgacttaagaaagtaattgtacatcataagagagaaaaattctgttcagagaagaactatttgaatatattttaaaagataaaaaaatgtcttggcaaaaataagtaagtaatgaaaaagaaattttctcgaagaaaaaaatgaaaaaaatgactaagtactcaatatccttgattttctagttttcattttcctcaaaaaaacttgtccacattcattctctgaatcgttcttctttggtatatactatcatgcgaatacgtcttttttcttttgatattaaaatatctacagactattttgtgcacctataaaataaattttgtcatgacttgtaattttcccataatcgggactatttaaggaccaaaaatacactttcgcccaacttgctgcttgaccaggactttcgataatctcctaattacactagctagtttttacttgttatggtttgtgcagttgagatagctcagtaaaatggctttatgtgttctgatcttataatgaatcgtaatcgaaatccacatatttcattcatactgacggagaataggttaagcgctgctgctatggtacctacttttactctttgtggtgtgcgattagttttgtaatacaagggtacttctggtaataaatatacaattattttatgaaactatgatacaggagggcagaagttctgacgatagagctacaaaaggtagtatcgacctaggaatttataaggactgtttttctttcaacagcatcttagatgcatgtagggaaaacaacgatgctgataatgcagaaaactactgcatacactactgaggtgtaattcatgtttcctgcagtaaccggtagtgtatatgggaaagataaaaataccaggcagaacaaggtccatagaatacatataatatgaggaatcatagacatacgacgacggttaggcctgctgacacaatttacgtcactctcgattctatgaatgaatttttcctttttaataacgaacaggaatataaaagaaggaactgcgtacgacattagtaacagggtgatgcatgcagtgataattgcgttgaaagcggtactagatcccataaatatacagccaattatcgttacacatatttgtgacaaaaaatgggcatataatggagacttaaacccaggtgtcaacactgctagcttcttcaaggatttgtttcccaaggaaccctctttataaaatggtgcgtaacttttcccgaatgattggaggattcgactttgccaggttccacttgcaatgcctgaaacaaaacctgttgtgatacacatacattgcaggaagacactgagattcctattaccagtggcctggtaaaatatttctacgataggtaaaatagactcaacgactgccgtttggtcagtgatgcagaaaaacaaaccaacgcaataaataaaactagttacaaagcccacaatgatggtagtgataataactttgggaactaagaaacgtgacttactataacccacttcatcaatcatgtgcgtagcagagtcaatgccaacaaatgcccagatcggattgaccaaaccgacaacaaacgccattccagacgaattccagcctgtttgattatcaaagctcccaaatatattagaagctttgggccatgggtctacggtgttgtcagatcttgaaacaatacaaataatgaaagtcatggcgaaagacaatagagacgtatagagcccaaactgagagatatagggcaacggagttgaataaatgttgaaaagtgtcaaaacggcattgatacactcgtaacccacaaaaacatgccagtgctttaactcgtagtccggatgcaacaacttatgaataccgatacagctcattgacaaagatgagcagatacttgcggtagtaaaaatggcaccgaaatagttcagcaaccctacaaccatggaagaaaccttttgaaatttagaagaaacttccacgttgaaagtttgacaataattctcgaggaacacttcttcatcatcgtcagaagggtcctcgtactcaggggttttcaaagtgactgattcttgttccaacattttaagaacccaaaatgaaccaccgctgctgtttggcaggatagcagcaaaatctcccagagatataccacacatgagactgaaaaaagcagcaattatcaacccatagatgataagcagtggccctccactggcaataccaacggccatcgacgctgagataccgacccatgagcaacttaatgagaacgcgatacctaatagggaccaccaattaaagtgcttgtcaaacttgacttctgacctttctgaactagacattcttatttccgtcctgtgacgatctggaacaatagacaaaaaaaaatttctttcatatacaaataggaacactgcccctactctgttcataccatgctacttatatatagctgatgaaagccttgcaacttttttatttaaactattctacgtcttgttgggtcattaatgactccaccgatggcagttcatgcaactccatatcctgatcatgtgccgtagtacattgtgcaacctgtgccataatattgacaccgaacttcttcagggcctgcacgttgccttcattcggttccccattgagaatgaccccaaaaaggtggcttctcaagccattatcgcaaagatgattccaagtcagcaatgtatgattcagagtccctagcccgctgcgtgccacgacaactacgtacactggatggccgctagtctcaatcagatgtttaattagatccgtcgtaatttccaatttacgagtgatgggaacgcaaaccccgccggctccttctacgaccaatggattctctgcgctccactcttcaggaactacgaaatccaacaacctgatgtcgacattaggttcgtactccatggcctggagcggagatagaggcttctgcagcgcataagtgggcgtgaatataggtggttgccaagttgatgcggctattttgaaatttttcaatgtctcggagtcaccttgatctgactcaattccagtttgtacgggtttccagtatgcagctttccatttgtgtaccaataatgttgatacaaaggttttaccaacatcagtgtctgtaccggtgacgaatacaattggttgttgttcttgttgttgagatttgctgttcatgacttgtgcgctagtgattttttgagttcttttcactggcctacttgtggaaaaaagtatatctctttatatacttcagtaaacgaactaccagcgggattttattttgttttgcccaataattttgaattataaatagccattgtttgtatatttcattttcttttggtcgggaggatgtcaacagcgcaattcgttttctattgctaggataacaactaatgtctcaagaaatttcatatacaccagatgtcgcggaactgctagactttgataaaaaacatatttggcatccttatacgtcattgagttcaccattgaacgtttatccggtaaagagtgctcacggatgcaagctggtgttggataccgactcaccagtggacgtcgaggtgatcgacgccatgtcgtcgtggtggtgtgttattcacgggtacaataatccagaattaaatgaggcccttaccaagcagatgttaaagttttctcacgtccttcttggtggattcacccataaaggagctgtgaatctagtccaaaaacttttaaaagtgattgatgaaccctctttgcagtactgtttcctcgcagattctggctcagtagcagtggaagtagctttgaagatggctttacaatcaaacatgtcaggggaagctactaaaaatagaacaaaatttttgacaatcaagaacgggtatcatggtgatacatttggcgctatgagtgtttgtgatcctgagaattctatgcatcatatctacaacgatcgactcagtgagaacatcttcgcccaagctccctctattgtcgatggtcttccaaccagccagaacggtttcgaggaccattggaatgcagaagaagttaccgatctcaagaagcaatttgaattgcatagtgatgagatctgtgctgtgattttggagcctatcttacagggtgcaggaggtttgcgaccataccatccacagttcctaattgaagttcagaaactatgtaaccaatacgacgttttattcatcatggacgagattgctacgggatttggtagaacaggtgagattttcgcattcaagcactgtcaaaaataccaggaccaacgtggcatcagtccttccgatcagatcaaagttgttcctgacatattgtgcgttgggaagggcttaaccagtggatatatgactatgagtgcagtggtagtcaacgacaaagttgcttccagaatctcttctccaaatagccctactggtggctgcttcatgcatggccccaccttcatgggcaatgccctggcatgcagtgtggcagaaaagtctatggatatactactgcgtggcgagtggagaaaacaagtgtctgcaattgaagaccaaatttatagagaactataccagtacatcaagaacccagataatgggctcattggaactgttgttaagcgtgtgtcagttattggagctgtaggtatcgtagagctatacaagaagacagatcccgagtggttccagaaaaagtttatatccaagggagtacatatccgacctttcaactgcctgtgttacattatgccaccatatgtgatcacgacagaggaattgacgaaggttaatcaagtcttgattgaagtattacatgagtggaaatcccacataaaccaatgatatacgatcttatcaagtcatttgccaaggaattcttatttcttgcgtaaaatgcattcttttacgctattatttatattgatgtaactcaaaataaaaattttatggttatttattctagcagacctttatatcttacttttcttatcataaaattatatcgaagcctgctgcacaagagaaaattgactagttcagggcaagaacgtatcacaggaagtacgagttgagaaatctggaccgaaatggtccgtggtcgcctacccgccttctgtgccattacggtactctcttctatgttatcccattagcgctagttacactcctcagcggctgacacatctcacgatcctatcttttatttattatgagaagaatggaaaagatgggatattataggctcagcttactcttcaagccactactgttgaaccgggtcgtacaactcatacctttgaaccctctggtaaatttttccggcagagtcaagattattattgaggcaaacctgtaaattcccttcagcatttgattatcttccgctacttgaaatcttcgactatatcttcctctactaacctatccgcagtaacaattcacaagaccttgaatgtagtaaacgatgtctatataacttaatattgtgtaagatcttacaagatgtactgggcccaggcttttcacggggatcaaactgttgctctcctagatgagaaaacgctttactatcacactgaagtagcatgggcagtattttccctcgaatattgttattatcaaagcaagcaatatcagcagtagtttttatttcaacatataagatcacctatgttgcaatctctgcaaaattagtaatgttaccctccaagtaattgtatgacctctcttctgaaggtaaacattgcgcctctttgtttaaagcagcagcactagtttatcatggtttcgttacttaggaaaggatcggtagtgctatgtaacacttggaaaagatgaaatttgttagcatgaaattgagtcccttgtgttaaggaaaaagtgccatctttaaaaacgcactctgcaaaatatggtattgcgcatacgaagaattaagaaactggcaccattgatcttcacatcattattgtctctcattgttctttttagggtctaccgacagtatccattctccgaccatttcgaaacacgcagagaagatgatcgctctggcaacctgcactgcttttctagactgcgtcaaatagaggaatatgaaaagccggaattgacaagtaaattctatgaaccgaatagatggaaatcttttatatcttacgttaccaggggtcgcaaggatgtgaaaactgtgtcccgatcgctatccaatttggatttgtatcaaaaatgctccaaagaaatccgtgctgatcaggatatttctcttcttcatagcatagaaaccaagttgttcccatatataaacttcgcagccctaaatagtgaacaatctcataatttttggcctgttcatacccgatttgatggaacaaagtaccgtggacaggtattacaattttcttctgagaacaattcgttcattggaacttcacccattgaattcaaggctagcgaacctttttgggagaactggttgaattcagctcttcaaaggaattcaaaaggtgtggtaatgagcgtatcggattatctggtggctgatacaattcgactaataagagttttgcggctgttaaataattcccttccaattgaaatcgttcacaaatcggatttacatgagagttctcaacagctcttgatagcagcagcaagagaatctggatccttaaattatccccctcaggaattgtggtttctggatgtgaaagacatgttaaatgacgaatatttagcgagatttaagagattttcgaataagtggctggcaattaccttttgttcatttcaaataccaatctttttggactctgatactgtaccttttgtcccgttggatacactctatgaaattgacggatttaaaagaacaggtacactgtttttcaaagacaggagttttccaacctccaagttaagtccactccaagttaaagttttgaagcagataattaataatagtctggacgtatcctcggattcggagcaaggttttgaaatcttaaagcataacctaaacgatgagatggcaattgacgcaatagaggccttgattttcaagaaacaaaaacattacatggacagcggcttagtgatattcgataaaaaaaaacactttttctgtctgcccatcgcaataatgctgcaattttcgcctatccaagagtttttccatggtgataaggaatggttttggcttagtttgtttatttccaaaaaagagtttactttttatccagtagaggcttcgaatgtaggaagattagagaagccggagactctagaaagcagtacaatctgttctacccagctatctcacacggacgtgtacggtaatcttttgtggttgaatggcggtttatccgtttgcaaaaaaaattgttggaattatgattttacaaagcgtaaagagattgcggccaaatacaaaagcgttgatgaattacagaattactatcaatcacctgtgaaactcgaagctgtcataatacccgatgtcagcaagtccccctggtcgcaacagagcgaatgcgttatgtacagctattgtacacattataggaagggacagtacggaaaattgatagagtttacagattctcaaaagaaatattacgagaaagttgtagaattatggaataaagttgtataaagtatgttgcagtatgagtacggtgaatttcctataagtttttaagcttttagatttctctctaaagcatgttaaacccttcttgacatcgttttcaaagcgcatatttcctacggaactaggctgttattgagatatccttatttaagttactcttggcgaaatgttattcccgcatttatatttagttaacattatgtgaaattcgctcaaaaaaagagcattagctttttcttcattttgcctcaagaaaactttaaaataaagtaggaatgccaacaatacttttcttcagtaaaagacgaatattggcatagaattttaccggtaatcatttatacttggcttagaacactgacacatgcatttttctctggacccttgcacaaatcatcagtagcgcctggatcaaaagctaacaaaataccatatctgttttaaacaaataagtatatcgcatgaagtaagtttcccgcacgtaaaactactacaacacattttcgcctagaattataagaatgtttagtgcattggctccgagcgagtaattgtacgatgcacgtgcataaaaagtgctcagcacccagttccgctattagcacagggaaattttccttacaagcgagcccttcaatagcttaggaagtaaggttactttggcgacggccatagatgcctgagtagcctttttcctttttccttccctcgagaatgtgtgaaatgacgttttcgggataaagcgggcgctagcaagaaacttctactaagagtaacgtggctgagaagagaagaataataaaggtatgccatggaataattttagaagagggggacctgcttcttagaaacacgtaatctgaatcccagagcaactgcgtacaaaacaagatcttggctttgtaagcaggaacggctttttccgatagaagaacgttttttgtttttttatgcaagaccgtctaaaaatttgcaccctatttaacatagacactcaacgaataccataattgcacctggtttcacaggaccctgagggaacaatactcaaaagaacaaagactactggtagaggtcccgatatatcccttcactgccggtgactatggtaaaaatgaggttacaatttctgtatcgttagagaaaatttttttcgttaaggcaaacgcatcagcgtttacatagggaattcctagcgtagtttaatgagcaaggtacatcaaaccctagtagttcttgcagttacacaaaatattcgttaaaagcagtttttctcctctttcttagtcttggctgactctcatataaaacaactagagaagctgagaaagactccagttaatcgtgtctcctcagcgtctatttcttgaacctgagatggctaaataagcttaggtaggcaaaaccatgttgttggtacatattatatctttccttctgttcttccagctttcggccgcaaaggccccacccagtaaaacgtctctaataaatactcatgagagaaggtcgatatattcatgctacgttggtttacgtaaagaaacatgggggttcaatgggtccgctatatgtcggtatgaaccagcaatccaatcgatgctttactgtctttacgaagacacgcatgagaaagggtattcaaataaaactttggagaaaggttttgaagaaatgagacaattttgctatacaccaaagtttttgaacatgactgatgccgagttttacacctcattgaataatggaacatactatatacaagatcaacctaaagctggcatcaatatcacttatcctatcagactgaacactacactaagaaaagcatactatgatgcttactatggttactactataaccatgacattccgtattatttcgggggcattatctgtgcatactttgtgggtgttatgttgcttgcaggtttaattcgttttttgaattataccccaataaaaaagattatgtttcagcaaaagctagtcaattacgtgagaggttatactactctacccactctttatgaaaagcatgcagagcctttctcatacttaaaagtgataacaggctatcttcctactaggtttgaaacgttggttattttaggctacctcatacttcataccattttcatggcctacaaatatcaatatgatccataccacatcatatttgccgctcatagagcagaagtggcacattttgttgcgtacagaagcggtatactttcttttgcacacctgccactcattgttttatttgcgggaagaaataactttctccaacttatttctggcttgaagcatacctcattcattgtgttccataagtggctgggaagaatgatgtttcttgatgcaataattcatgctgccggctttacgaactattatttgtattataaaaaatggaatacggttagattaagagtctactggaaattcggtattgctgccacctgtttagcgggaatgttaattttcttttccatcgcagcatttagaagacactactatgaaacgtttatggccctccatatagtattcgcagcactatttctctatacttgttgggagcatgttactaacttcagcggtatcgaatggatttacgctgcaatagcaatttggggagttgatagaattgtacgtatcaccagaattgcactcttaggatttcctaaagcagatctacaactggttggatctgatttggtccgtgtaacggttaaaaaaccaaagaagttttggaaggcaaaaccaggccaatacgttttcgtttccttcttgcgtccattgtgcttctggcagtcgcatccatttacagtcatggattcttgcgtaaacgatagagaattggtcatcgttctgaaagcaaagaagggtgtgacaaaactggtaagaaactttgttgaacgtaaaggcggcagggcatccatgagattagctatcgaaggcccttatggctccaagtccaccgcccatcgctttgataatgtattattgttggcaggtggctcagggcttcccggtccaatttctcatgcccttgaattaggaaagacaacagctgcaagcggtaaaaactttgtacagttagtcatagcagtaaggggactagacatgctcaacgcgtgtaagaaagaactaatggcattaaagggcttgaatgttcaagttcacatttataattctaagcaagagctagcttcggctgaaaaaatttcctcaaatgaagtcaaaaacggtgaaacgacagcagagaaggccccatctagtctaagcaattcagaaaaagctccttctgaaagtgaaaatacagaactacctctttccctgaatgacacgtctatctccgatttagaatttgccactttccatgttggaaggccaaatgttgaagaaatactaaatgaatctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtgaacaatttttcatatttaagtaaacactcaatgtataatatcctctaactgttgtaatttcattaacgtaaatggtttgcgccttttttaggggacccttgttgattcattctaactactgaggcataagttgtttcaaataacactttttcagaaaaataatcgtattaaaaagcagaaaaatcatacgtaagatgacagaagcttcatatttagtaactctgaattgtataacacaccaattgccgatagaatatgaaccaatcgatcttcagcgttcatgtacttaatttaactacctgtattttcttataaagataaaattggtgtataatgtaagggccaagagaaaaaggaatcccgcatcccaagcaacttctagtggactatttcttcaaaaaaataactgaataaacacctatataatgttcagaggttatactttagtgttttagaatgcagtaccaaaagtaatatattgaattaataactatatgatgtgtagctaagaattaaatagtaaacgtcttctgaaaccttttaagaggtaattattggtattccaaagtcatatgtggaggtaagggagacacaaaattatctggaatgacagcgtgctgacacatataaagttccgtaacttcaaatgccttcattattcaacataggaaaagtgaaatgtgtgcctctaaaatatacggaacatcgtcgaactaaaaaaatccattaagcaaagttagaaacagcatgcactacaagacatttggttcatcatgaagaatgctcaattgaaccatcaatcactttctcttgttcgatgttagcattatcctcactatcagttgaatcctcaatgctttcggtttcagtcctcgcatcttcctgaacttcaagatctaaaagaggctcactctcttccagactagtctccaagcggtccacgatatcacgtaatgccttcacacaagccttcaaaacaaatcttgtgcttgacccattttccttagcttgagataggactgtgatacaagaagcatatgtggtagcgagaaatagtatgaataaaatggcttctggtaaaatatctattttagcaatcttacaagaacctgaataatcaaagttcataccccgtggcatacttgagcaggaaatagaaccaaattttgaagctagagttacgaaagcggtaaaccacaggacggtctgaacaatttccatcacgaatattaacagaacaggcaaaaatctcacaatcccaaaataaactgaagatatgattgaaacagctaagctcagtctaaggattcgatccactttgtagcttgtgagtatggcaaaactagctaacaacaagttagttacagataagccaagttggaaatatcttagtacgtggaaagtaacggatgttgttgttaactttaacatatatgtaatgagttattattatagatcttgacttggtaacaaaatatcaagctgtaagcaccgcctgtattctcctatttatggttgattatattttacttctgttgaaccaagaaaaaaatagcaactcgaaaagtcccttattcattcacttttttaatttttttatatatcgcatacgtaattggaaacacgaaattttaactttgggcaaatacataaatccttttgagaagttggtttttagtcttcaagagattataaaccaacatccttaaaagatagtattcattcctcacctgccaatgcaagagtggatattgttcagcaagcagtgcagcaaatcggaagcgaattccaataaaaatttgcagaataagattagaataatatattgagattaaagaaaaaggttatgcgaattgcctaaagtctttaactttgaagcggccaaactctaacaaaccttggctaaaatacaagctttgccggccatgcaaactgattacatcattcagtataaagtgccatataaaagaggcacacttttccacaactgatttaaatataataaaagaataaatcagaaggaaactttaaatattggtaatatttatttatggccgctaaaagattagtccagatatatcactatagaaaaggtaaagataatacactatcatttccaaatgtaaagtttgttgatagaacgccataaaaaagaggctgactttttgtcgtccaagttcttcgaaaaaatatatgtcaatggcacccgatatatagctggatttggaccagtacacgtctaaggaaatctaacacctttttttcctgagccaaataagcggtggaattgaaacagctaccaaaatcataccaaatccaaccgcaattgaaagccccaatcttgtgccataaagagctgccaatacaatcggtgccaccagtttaccaatcccagagattgctccaattgaaggcatcaactggaccttgagtttggggtcgatgtacatggaaaaaagggctggaatgctcgaagccaaaaagttgtaccctaacaatgtaatcgacatcccagctgaaaaaaatataccagaatttgtgggtggcattgatttatgcttcaaggcttcggatgctccaatcataaaagcttgtcccagcaatgaaacaaacaatgcaaagatggacagaaaaacttgaccgctgtacagcgaatcttttttctttacctcaacggtctcacttccagttgtatctgactcttctaatccgtcatctttggctctgccgcaggagcacccgacgtttattaactttggagcgaaatagcttccagccacaccaagtatagatgcgaccataaacgctatgccttgaaacttggtgtcccagttaacgtggagcgtcaggaatagtggcataaaataaactacttcgctcataataaatgatgataggaacatgctccatagtaaaatcaagcaggagatgagtttttttctttcgactctaaaaaattgtttcagagcactgaaaaggctattttccgaatttgtaactttaacctcaggattttccagaacgacaactaataaaaggcatactgcaagaattatgaaactggaggcaaatgtcggtgcattgtaagaggcaatgcgataccctttaattttaaaatcgcaatatccaaaaaatatgacaattaattgtgccaacgccatgaagataccagccgctgttcgataaattgatagaagcttgaaaacgatacccctatcttgtgcaattgatgtgatgtaactgaacactatagcaccagaagcagatgctgcaccacatataatacgcccaccgagaagggtgtttagcgacactgcaccgccgcatgaatacaaaaaattacccacaaaggataaaaagtaaagccccactattacccattcgatggacccaagaaaagcagcaatatccccgataatgaatgaaacaaaaacttgaactgctgcagaaatggcttgaattctgaacaagaatttgtccggatcggtttcttcgttctctaaattgttagcatactagttcattgaaattatcttagatttacattaacacttacttctttgatgtagtcaaccacacttgagagatatacacaggagtcgaaactgaattggacagctatcaaaattacagccaagtatttcaaaaacatgtgtttcttgacacctaagatttttttcattttaatttattgtaccaccgtcgagtgaaatggatggatttgtaatgcaattgagatacaattaagaagaacgagagagtacttgacaactagaaagtaatgttaactgatcttttatatgatgattatttattgacggcgattcttttcccgattaggaaattttgttccgcttagaatgggataggcttgtttgggcgctatacttctgtatcaaaatagtaaaatcaacttattttagtaatagaagagaacagtaggcgtttggtaattctaattacctagactgtcccccatttccagacagctgtcccatatttttttgagattccgacgtcgaagcgaaagactagaagaataagtaaagtggtccttgtaagcataaagacaaaggcatgtgagaaaagtaagtgtcttcgcgattcgccgttgtaaacatgtatcggcttttgttactgccgtttcctggcggatcacagtaatatattagtgttttatataattcgagctctacactcaagcatacatatatagaatagctcatttttaatgggctttctcgagaattattcacccagaaggatatcctgaaccttatatttagatgtaacttagcgtgcactaaaagtcagagtgttatgaatgacttttgaagctaacaaaatatcagaaattaaacttcattcaagaatgtatttatctagaaactggtctttggcaaatggctccgatggcacacatgcaatgttcttagtaaaaactaatttattcttaggccagtagagaataaaagttgtcataagaaaatttcattacattttatctcttctggcaagtatccaaattcgaaaacctcagaaaccagcattccacctaaagtttgtttgcccgtatgttaaaacagtagctgccaagtcacttgagtttgaagaatagtctgatgctttttacataaaggtttattaggctctttactttgtaagcatctcgacttaaaaaaaaaatctattgtttttacgggcatcgctgaaaaactgtgtctgttctctttgatgctgtcatctaagattcaattaaagccgaccatcaagttcccttaataatatcccttgtgagagcttaatctaaaactacaaaagtgttcgcaacaagcagtatggacaggcctaaggacgctagaaagagatctattagtttggcctgtactgtgtgtaggaaacgaaagttgaagtgcgatgggaacaagccatgtggaagatgtataaggctaaatacaccaaaagaatgcatttatgatattgataaaaggaaagacaagagaaaaatcaaaaacgggtcgaaggtttttttattcaagaataatactatcgataacgggaataactctatactagagaacaaaggactaaatgaagacctttcttcccatatatatgagaaagaagcgccaaaatttgattcagatattgatatatcaagatttggcacaaatgatgctgtgatttttaataatgacgggtgggacacttctcttccgatcgattttgatttcgatgagtttaacactgagacaacagatttcgatgactttttaaaactattaggcgataattcaccttcaaaggaacaaaaaagtctttcctattccccaactgccataggcttaagcggtgtggttaaagaaactgagagcgaagataacgctcctacgaggtctcggctaatcgatgtcttgtttgagaacgagcttcactccgtaccaggaatatcaaaatggcatctatatgagctggaatcccaatacccaaatttggaatgtacagaaggaaatagtgatgaaaagtttttactttcaactgtattgtgcctggggtcgttgaccatacgaaaaagggaattattgaatcattcgaacatagacaatagtccacttttgccagagaatagtatttcaaaactgaccgctgatgcttttaagtactataatgctgcgaaaacgcttgttcccgacttgttatctcatcccacaatcgatggattttgcggcctcgttctaatggcaaatttcatgacgatgatgatatccttagagcaccaattatatttgagtataaatgctttacaacttgctgtggctttaaacttgaacgacaatacaaaatgcaaggaattacttgagtcgaacagcgacggaattggtgtgatcttgcttttttggaacatttggtgttcttcttgcatgttggcaacaattcatggaaaaaatccttttatcactttggaacaaattacaacacctctgccgtgtgaaatatccccccgcaataaaaccaataaacttttgatagatttcatgcaaatcagaatcaagctagccactctacaaagtaagatttttcaacggctatatacttccagcaccgcaaacgaggtaccattcgtaaacttagaaagagaatttgaggaagtttcactccagattaccaggttaaaaggctttccgatattcgaagaacatcttttttacaggagcagagtcttaatgttagagctatcatgtttaagagctcaagcttcttttctattatatcgtccgtatctgatcactggagaatccttacaagcagtaaccatggcaaaatcaataattcacgaaatatggagtcaatacactaaacagtttcccgataacgaaaaggaaaggcatgaacgtttggattggaatttttgttatcctttaagaacagcgtcactgacattatgtatttcatgtattatactcctaaggtataagcaggtggtgcagttccttaaaggtactgaactatttgaatacattctagcattggaaatattgcaagatttagttcaggtacttcctattgaacaaaaccttattgatataatcaaatatccgatcagtccagtacagctgagtggtgatagctttgtcgaattttggggtcgcatactttactaaaccgttccctagctgattttttgacactttattcagaaatgaccttttgagatacaagtttactaggggaaagatccatatgacatggtagcaggtttacccttcaaaacaacatagagcgtaaaaaaggtggctgaagaacttactaaaaatgttatatgcttagattagtatattgtcaccgggctaccagtacaaacccttgataatgcgaccagacatctgttttgacttatttatgagcaataatgggtaacaaaagaacgctctgaggcgactctgtgtgagtcgaaacatatgtgttttcggcaattaaacaaaatacgagagattcttctcagaaaacattgtcacaagaacttagtatctttaattttctgcaaacatactgatgatttcttcggcaatagcaactacgtgagtttcaagcgcaaaatggccagtatcatagtaaacaacctttaaattatcaacgtctttccgataagcttcagccccggcaacgctaaaaatagtatcattcgcaccccatgcaactagcacaggaatctttgaatctctcaagaacttttgaaaggctgggtacaactttatattattctgataatcgaaaaataatctcaattgaatatcggcctggccgatacgttgaattagcgcaatatcaagcgtataagcggcgggatcaacagattcgatatctggcactccatcatggtactggcatatgacattagctggatcttgaaggtacgggataagggatttaacaaacaccggatcactttgatatgacttccaatattccttcaacggaccccaaaagcggtcatcgagaccctcttcgtaagcattaccgttttgagtaacaatgccagtaattctagagggaaaattcaaggctaaccgaaaacctaccggagatccataatcaaatatatacatggcaaatttttcgatcctcaaagtatctaacaaatatcctatactttcacaaagggaatcaaagctgaacttgtagttttctggcgtttccgtaaatccgaacccaggaagatccggagcaatgatgtgaaactgtccagctagtaagggaatgaggttcctgaacatgttggaagatgtagggaacccatgtagcaataaaattgtggggttacctgctgcaccggcctcacggtaccaaacctttacaccgtcttgaacttgaatcttgtgaaatcttgcaatgatatttgacatttttgtccttcgtccaattttgacagtgaaagaaaagtggtcaagttcagttaatttgatcgtgcttatatatgttctttttggctcctatcacttttggctcctatcacttttgaaatttctgtcacgattatgtgcggcgcagtccctaggcaagttacagacgaatggcatgcagcgccgtctgtggaaaagatgaatactgaattatcatacctttaaaggactatgttaataacaaagttgaatggagatttagaaaatgcacaatattgagaaaatgcatatgcgtactttttgttagcaaacatacgattatttagtctattaaaaaaatctatttactcgtcctcgttgcgcacagcagttgaatcaggcttgtgaatagcactacgtgctggcaatgcgtctggaatatcgctagtggcaggctggtctatctgtgacgtgtgctcttgttcgggcctgtaagcatcttcttgttcaatttcaaaattactgtcttgacttgtgaaactggataaatcgttagcatcttcatgcaagccatctgattcatctgaaaactgaccctgaagcagcgaagagtaagtaggaccttttctgttgccaaaccttgcccttaattttgaagaaaagcgtgctacacctgccttcgtgcgttgaaatgcagacctagtaactaaagaaatgtatattcctagtttcacaacgatgttgacagctctatcggtattattgttttctatcagtccatcgtctcctagcctaatttcttcaaatcttgaaaaccccccatttctcctgatacccctatcgtatacgaaccatacggcaaaaagaataacgagaagaattataacaaacaccagcgcataaacgccggtgtttatggagtatttttctttgaatgccttttcttttcccggacaaggatgtggtgctaaatgtgtatccaatttcagcccacctttacaggttgataagggaattttccgatagccggaggattcatagtattcaattaagtctggttcctttttacagatatcggcaccattggccgaacttaagcctttgattaatttacaagtaccatcactggctttataaaaattatagtcacattcgaaatcttgtcttgtacatggacagtttttgacgttcctcgaaaattcagaaagtggaatattcccaataaaacatttttcatcggttttacgtaaaaactcggtttgatgaccaaatagacaactagtatgagaacccagaggagaatattgaaaatctgcactttgtttaccggtaatatcaaagtcacattgcctctcgaaaatgtttctaaaatcaattgtgtacgttctaaatgaaccactccccnnnnnnnnnnatgttttttgcttctccaaatagcaaaaacctcaaagcagaatctctgggaacggtgattatatcctttacgaggactttgtcgccacagaatttataatctttccatgttttaccaaaatcggtggagtaagaaatagaatcagtttctgcgttttcggggaccaaaaccaagactccaccatgatcaccgtactcccattgatgggggccttttttaacctcagtccacgtctctcctccatcagtggttagaaaagtggaacactcctcatatggtagaagcctatcgccaacatttccgacaccaaacatcattcctaacgcggagccagaggaatatgtatccctgatatccttacgttcagtgtaaccatgcaaatgtagagaacatttatctaatgacacagaatcacagggaaactttttcccttccgaatccttctttggaggcttcaaaaagttccaatctgaaccgtcattgaaggtgattttcgtcttcaattgttcgtcttccttgttctcgccaaccttttcgctattcgaaacgatgttggtgataataataccttcaagaccttgaactttttcaaagtccacataaccgaatgtgtttctattaacggcatgctctaaggtgacaaaagaagtaccattcgagttggatttcaaaaggtttccgaaatcgtgtcctgattnnnnnnnnnnctaagtttgttgctaaatgtaaaaatatcgatcctttctcagatcctaaaatagtgaatgcctcttgcttactaacatcttgatcatacgggaattttgcctcggcaaactcagtaccatcaatagttacatatgccgtcaactcattgtcttcatgaggtacggcaacaataatatagccaccagtggacaagtagccgataatgttttcaaagataattttattatcatcttggaaaaaatctatcgaagaaaccaagcttcttgtttctgaagacttcttttttacttggcacataaccatctcctcatttgacggatattcaaagagtgtgcctgcaaactcacaatgaattgcattatcaagcatttctgtaaaagtttcacctccatctttggtgaggtatgctactgcatgacattctggacttaagattgattcacaattcttgccaccatagtaaataaaagtatcctgtgctttagcactaaaatctagtggcatgcctaattgcctggcttcaggtaatttagctatcataaaagagtgtcctctatcgtgtgttgagaatatgttacctttagagccaaacaaatatgctgaagaattgaaatatgggttaaacacaacttcaacaattttttcgccgttagtgtcaaacctttttatcgtttgtccaccatcgtgggatatataggcgtctcctatcgaattcagcatgaccaaagattcgtcggcaactgtatcgaagtattggtaaaatttaatttcgaagtcaaatttgttttcagtggtcactatttccctgtcactcgaaccctcctctggaatttcgtcacacggaatatctacgggttcaattttcatgggtgttttacatttatcacctttgattaattgtaatggctctactaacacagatttatccttcgatttgtcacatatgttggaaaaggcaatcagattataatctggtatacacaggccgtttgcgtccctaacaaattcaaacgaacattcgtagtcggattcaccacaactattacaaggcgtttcatctaaactcaaatctttgaatgctttttttaccaaacactgggcgtcttgtttcctccttctatacttgtatttggcgccattaacacatttcccatccgccaaatcccaatcttcaaaatcttcttcctcacacgttctagagtcaaatgctgctgaaaaatcaattatatacgcgacactttttaaagaaattatactgttggtttcggaatcggtagtggcaaaccatccgctgaaaataaattttgagccagatccatctggtgttggatttatcaatttgtgaggatcgacagaacttatggcattggtcagctcatattctttccatgttctaccttggtccaaagaataataaaattcagattgaaaatcgccatcttcatttggatcatatgggatatacacaataatatttcccaggtcaccagtagcatataacccagaagagttatgaacaaatctccacgttaaaccgccatctctagagatgaaagttttttggtcttcccattcgaattcactaccgtcgccaacggaacctgtcattaacataattccggcagtaggatttgagatttcgatactataaaaagggttctggagcgaacatctttcaggcctagtgatatcacaagggaatgaatctgcattttcctcgtcaaccactttcaaatttgaccatgtgaggccgttatcaacagatattttagtttcatatctggctatctttttattatattttcctttgttatgagagtagtcaaaggaaggatgaaacgagccaattattgttccttctaagaaatgaggagaagcaatatcaatataaccaaagtgaggatttattgtccattcaacaggtaaaaatttcaacccttgagaatctgatattaaaatttctgagggagctggttggtcgtttttttcatctgtgaatatcgtagatataggaatgattattcttccaatagaatcttcataaattccatacatatcgacgtgccgtacttgagcaggtagacgtgccttttgaaaagtagacgcatcattggatatccagatatccatgggtgacatttcattgtatctatcatcttgtgtcgaaacgattatatgtgattttaatatcttgtattgatgaataactttatcattaaactcatcaaattttttgaaagttttacctccatcagtacttaaggctaattgtgtatatgcggcacttaagtgacgatcgctatcgtaaccatggttcgagaacaaacatagtatcgaagcgtcgttaccctcaatatcagaatccttgctagatttgacaaagttgcagcttgaacttgttgtatggtcatcttctttctttttcaaggaaggttcgatattgtaaaaggattccccatcgttggtaaagtaaatttcattttgtatttggatataaccattgtcggttataaagcaagggcaatctgcaataaggtactttttatctgtcggatgggtagctatagagcaagaagtacctaaacgacagttttcagagacgggtatagtcagagccctccatgattttccacgatcatcggtgacgtaaaatttgggtgataaaaataccgaagcaaaagccctgtcctgtccatgcaaaggatcaacaattaattcgagaatatgcccttcaatttctttgaccgcttcccaattttctccagaatcgaaactcatccacacgactctattatctaatctgattaaactgttggaatcgtcaaagctctctagactaaatgaatattctgaaaaagtctccgttactttggggacgaattcctctgcattgagtaacggaataaagagacatgtccaaatcgtgcatatgacttgaagtaatatcataattgaggatctcttaccttttcttagttcaaagctttttttcaaagctcggaactttatgctacgattcaatgactaaaaaaaaaggtagcggataatcttttggttgcaaattggtggcatttaaatatattttgggttgcaaatattctaaaaatattctcataatattctaaaaatatccagcctaggtaattgcaattattttgagtctggttattttgagttgaccatgttcacttccttttcagtcatcaagacaacgtgtttaccatctaatggggaatccaacagataaaactagaaactgagcaaaaatactttaatttgctaatgtcgccagtagtacgataatactataaagatacgctgttgaacctgatttgtatatttaaagaatgagaatctttaagggatcatagcctagattggtattctgcaaaagaaattttaaatggtgaaaacttttcctcactatgtccaattgatgcttcttaggatgacgttagaattttacttcggtgcaggcattaccttgataaggtcattcattaaagtactaatatacctcttactggcatgcatttacctaagtggtctccgttagccgtggtcttttcgaacgcaacaactttcaagttaagtaaaaatgatttattctataaaatatgtatgtaatgggaaagactcgacagacctgcttgccaagttctctttctaagcaattgagtttgccagtccccctgaaaatgctaatgcccatgtgcgactcattccgttatctaaatatgtggatgaatcaaaagttgaatcactgaaaaatgcatacgaatcttctgggtcgaagagtgcttgattcagcttcaatatgcctgtccagccgctttctatcgattcaataattggctcgattttagtctgccattcttcttcgacgaaagtctcagaacgaatattagaagaaactggtgtgataggtagcatatgaataccgtggatatattctgtgtttgttccaaaataagtagtataatcgataatattatcgaataaaataccactcactttatttcctatgatttcttcaggctcaactgtgttgtcattttgataatagaaatagtcgttcattgcatccttcattatactaatcatcaagtcacccctcaattccattgactggtcaccgatagtggccccccataacttcatagcataggcaaaattgtaatcttcactactactttcttcgttcttaccgttaccgttttcataaagtccagctgcccatgaatgaccgttgaaccaatcaaacattctcgattgtgcaaagtattcatctttttcagatggatttgcgacatctcttaccaatgaattgacccaatctttattgtcggcagcccaagtaccattcagtttagagtcaacatagccgatgacagcagctgcatgaataatgtaaccataatggaaatgatggtcattgtaataagtgttaccaaaatcgtattgcgtgctggtggaaccccaatctcctgaactgaccaaaccgttgaactttgtgtcgtaaattagtggataggtctgttcattttgtagcagaatatcaaaggccgatttgatgttttccaaagtactcttagtactggcttcatcttggatgatttcggagaccgttaatagaatgtaagaatacttatcgataactttacccaaataatatgtgtttaacccgcttatactttcggaaatactaacctgtaattcggaattggcaacttcagctaataattgcaattgttcttcagaatactctaaaaggtttgagccaagttgagaagaccatggtaaccaagatatttgtctgtttaaagatgtggaaaattgtaggctcgttgttagataaccgttcattacacccttagttgtagaagcgagttgaatgccggtataatagtcttgcattatatcactaaatgaagattcatgatggggcaaggcaaaaatcattgtgctacctgatgccgactcaccttgggtggtataagaaaattcataggtagctgtagaaccgtcagagacaccctgcagtttgaaattagtaacgtacatacctgcggcttgatcataaaagacctcgtaatcagtttcagaaggtgcgacggccaattgaataataagaccatcaacactagcgcttgcttcaatttcatattctgagctcatctccaatgaaaagtccgttgaggttaaatcgtctggtcctatcacgtaacataaccaagtgactccattcaaaagggtgatacgatatttgagaataccctgagctaaattgcttgatgattcagaaacaatgatattgaatccgacgctggaaccaatcttggcatttaaagatccatgatatataccagttgcaaatcccataccttgaaccaaaggaatttccaggtagttcgaagaatcattggattctgatagcactacccttgttgaagacaaggtcatttcatcaacttgcatagtcatacttgaatcaaaattcgaagctgagaaaacaacatgagcaattcccaaaggattgaccaaatattctgcattaccggaactgtcataaccaccgtagctatattgatctactgttgtatgttgaacagcaaaaccatatgaactcgaggtgtacttccacaatgaataaggatacacaaaggcaggtgattcctgactaccaacaatcaaatttgtataaaacttgtttgtttgaatgggaccatcgtttgacaccccgtcagccaatgacataggatttggtgatctgtcaaaaacagttggtggttcatctgtcgaaactgcattgaaaagattgacaatggtcgtcgttgaagagttttccgttgtggtagcggtgctactagtcgaggttgacagagaagaggaggaagtttttgtttgtctcgaagatgaggacgaagagatggtagcttgcattgaagaagatacataaatggtatctaatgtcgaagaaaccggagaggaagaagaatctactgttgaaaatagtgatgacgaaagaatgtttcctgttgaattcgatggataaactggactaacagtcgatgatagtaatggtgatgatgaagaaccgttttctgtaatgtttgaagggtaaattggaccagttgtcgaatatagtgatacagatggagaaagagtgatttgtgtcctattggatgggtaagcagggcttgctgttgtagatgcgagcgtctggactaaatcctgggttgagttggatggatagaacaaagtcgaggaagcaggagttgaagcaatgaaggaatcttcgccggtagctgtagctgtatttgtccttactgaaatagtatatatcgttttattcgaggtcaatgaagaaggaataatttttgtttcttgggaagaataggaaggcatttgagttaccagtggatcgattgtaccttttgaaacagaagtcaataaagttccatttagttgtgtccccgaaatagataaagatgaagaaaataaagtcgaagtcgaagtcgaagcagtttgagataataatgtggtgactttacgcattgttgatgcacttggcatgactgaggcgacgccggaaaccgaactcaaattgtctactgaacttttgcttttcgaattatcatttgcgtaaatatttgaaacagtgacaggatcattattggtttgtgcgcttattttttgagatacttggcttgcgtagtttgatgacgacaatgacagttgaactgctgttcttgtattagaatcactgtcttgtgaattaattggagatgcgctcactctattttttggcgaaactgagagagggctatgagaagctgcagatactcttgttacaaccaccgattgtgcaacataaggctcacctactgtcaaagtagcgtaagataaagtttcaattaaatcagtttccaatattttgtctgcattattcgatatgaaacttatatatgaacattcgacgaaacttaatagaaaaagaagtgtcagatataattgcatactagctgtttttttgttttcttttctgtatgcagaccgttactatggttatctacttgttgaaacaagcacaagaaacatacttgatattcatttttgaaacaaattgcaccaagtatttatatgtagtcctttaccctcgcttgtagtcttcgtatggtgtatatgctttgctactcttttcatacccagctcttatttttaactttttgggttcagctttatgattaactagtttttccttggtaaccaaattgggagatttcgtgccttttctgctggctttcataacaaaatatagccgaaaagagcttagcgcagctgaactcggtaacaaggttcaggtaaaaaggggagaaaaaaagaaaagaaagccagatctttcaaaaatatgccagcaaatatcaaattggtcataaaatagctagcactccgctatcgagcaagttctcttggcaagcaggcttattctattcttttgctgtaggaaaagccagttctatgcttataaccttaggaaacatatgcgcagcttacagcgcataaaattgatggcaacccatttagtggtactattcctgcgttattactagtatggtcgctttaaacagtggtaagatttcacattttcaaatctaagaagcaaagtttatcacttgaaatgtacctctctgtgggctttcactaccttgtacattttcttagcagttccgtacatttttttaaacaatgaaaattcaaagttctatgtatagagattatttaggtttttagtacttaaagtattttgagaataccttggcaaacgcagaacaatcgtaaaagagattgttactgcgcactgtttccttgctttatcactttcagttctgcaagaactaaggcgtttatcagtaatgatactgtaatatcaatagcgataaaaacttcgtcagtgaaaccattctttttaacagcaatctatcaaataaaagagtttttaacttgaactgggatatcaatttcagcagatccaacacctttatcaaaatgaagttttacgcggaggaaatatgacctcgagcataaacaactttcaaaacttggcactatggtagctttaaaatcatcattatattttatatttaataacaatgttctcttatactcagttgaactgacctgattccattcatttgatttccgatgtgaaagtaccgaatggtgatagtttgatggggagatttttttattcctagaagttcgaggaattatgctggatataggagaagaagcaacaggcacacttttctctccaaccaatttcgttttcaacgcatttttcatgacaacaacattggcttccatattggctaaaacctgtacgtccttaattatactcgaaggcattaaatcagaaaaatcgagcgatctattacgcaggctagctcttgcgtcatcggcaagaagtaagtttatttttgtttgatttttagtgaactcatcgcgatatgcttcaatgttttccaaaatttccttaaatattttcttaatttcattgtatttgtgcttctttaaaagtaaatcactgtggaacctcactggtttgcaatcttttgtgttcgttgttaagcaaatcaattccgtctccagactactgatttccggtgggtcatgtggaatactattagcagcttgcatacatactagttcaagccgtaaattttctagtttttctctctcttcaacggacaatagacctcttaaattagtccagttcttttgattctgcctgtttctcattgaaaatacattttgtttttgaattagatttggacaccaatatggcaaagcattactagggggctttatttttattgttataagcccaattttctctgagttagtctttgaagtggtattatctggttgagatgaaggaatattacgcacacttttgagaaacacatttttcagacctgtgttgaagagagatgctatagagtaagtaatttcagtttgaattttatcttcttcagagtagtgtttctttttaagtgttccattttcagtatttccagctaccgcgttccattcatacttacctcttgggggtgatagttgatcagagcgattcgcctcctgtatgtcctccttatgaatgggaatcgctcgctctattttagaaaagactttttcgatcattccaagcctgtttgcaatttcaatatcgaaatcctctaagtctttgaggcacttctccctactaattggattgttttgaaagccaaatggaactatccttatgctatactttttttcactcattaaacaaacacgcccagaagctacgtctttgcctactatcatagtatttattgagtaatttattaagctgccactagaactgtcgtttaaccatagtgaggaacctctttctgacaaacgaccataacctaaactctccgaaaattttagagtagaaagctctggatgagaactcgatggtctatcaaaccctaatgtagggggcaaaagagagtgagagaagtggccgtgcttacaggttacgtctaataactggttcggaattttaaaagtgaaaaatttcttacgtttatcacctggatttagtatcctactattcggtaatccaaagcttgttttatcaatggagtcaaaaaatccacaaaggtcttcccccgtgttcacgtcttcatgattatatgaccaactcgctgccatatctaccattctcaaaattctttttgtcgttttttggattccaaagggtgactgtgtttttgaacttgtcgtaccttccaaagttaaataaaacatatcgaattttataggtttggttgatttgttttctacagtgaaataaccatgaattatatccccagaggtgtattcccttagcatgctctcgtgtttaggaagctgtccaaattttggagccgtctttgtgacgtacaattcagtcgctatgggggttttaatcctaggcaatgcgtatatattctcaactgggatatctttagtatcatcataattacgaatttgagacacagcagggccggaagcaaaccggcggccatcaacagtcacttcatgattatctgggccaacgatatcaccggtaagaatccgcatatcattcccagactcaccttccgaaggaatactctgatttccggaagcaacctcataaaaaggtggattctccggaaagtatgtatcgaaactagattgaggtatattgctgagcaaattttcatacatctcgaatgacggcaatagttctggaaggacaaagtcatcttcctgaacattcgttatgctcgagccgtgatctccattattgcatgcgaaagcgtcttcttcctttccttgggatgttccacatctcggttcctcgaaggaggctcctccaaagagtgtggatgaagatgaagatattctttgacaaccttcaaatttattttgtggttcttttgattcttgcataaagaaaaaacttgattattctttagtcttccagaccagcgaggctatttagttctattagattgatataccaaagcgactatggagcaagttttacaatatctgtatgattggctgtaaatgcaaaactaattgtagtaaaccaacaagtgctatgctctttaatcaagggaagcatttaagaagtgatgtgatcatattttgtacaattggaattgcttcccttctataagtatgaatttttgttcatatcttccaaggaaatcagttaaatggcattgcttatctactgaacatttagtaagcaaaagtgaaatttctaggggactgttcgctaaagctgtgcgcggtctaaagaaagcggtaaagatagatagcatctagtccaatgagacgagaaaatatatagatgactcatagaagataaagtagtcctaaagaatagtggtgcatcttctttaagcctcactcattctcgcttattctttcgtatatttgcacaataggtacgcttgtcattatgtagattctcaatacttgatttaagcagacaataacaatttccaaacggagacttttttttccatgacattctagaatttgcacattttggcacctctgaaaagattgcggatgatagcgtcgttcgcaaatcccattgattctatgaagccgcatccagggtctaaattattgcgcacgttttttcggtgtggtacacactttagtcaattgtgttgtaaaaatcgattgttgaagatgccacctaatgtggtcgctttctcatgacaattgatggcgaaggtttaagctcccaattctgttgtttgcagacattcattagaccaaggtattactgacgggctatatgcggttagccggtcattgtagtttcacttctaaagagtacagtaacgttttgaaagtttcctttctcaaattgtctatggtactaacattgcatcaacaaatcgtgttcgaaccgcccaaattctcacttctgcggtatggtttttttagcttggtgtcataaacttgtccattagacaagcaaggtcattgcggattcagctaaatatgggaaataaaacaaatttttagggctagggcaattgttccttgggagcaaaaaattagggcccggatatagccttgcacaaactgtacagttgcttatatgacggcagacggtatttatgtaagcaccttagtaaaataactttgtatgagacattcctgggccgtaatatgatagcttttagcttgtgaatgatggcacccacatcctgtctaaataattttaatctcgcacgctgttctagcttgtggttgtggtttgtcttgttcaaaacgtaaagcaattccctcgcgtaaaagtcttgataaacgccctttcgctgcaaaagacccacgcttttgttatttgatttttcttgatagtttgacaattcaataagtttatagtttgatttatcctttcaattttacacatgttaatgacatactgagagctcattggatggaagaaagcataaacgtaaatcagggtcctgtgtgtctgggtgctgtctacgttagtactattcggctgcattatattcccaattcacaaataaattaggctcataaccgtaattttattcgagatatttttggttacttcaaaatattgttattatataaagatcatataaagttcttggacaagattggatacatttagttttatttttgaaaatcacaaagatgaaacaaaataaaaaatatcagcgtgccgcattgaaaggtaaaaactaaaattaacgaacttttctaataaagatgaaagggagaaaacagtatacattgtagcagagcgtttagaaggagtactcagaaagttctaaaaaagccttatttcaaactcatgaagaaaaaaaatttccatgaatgaatgattgtatgatggtattggcatgtaatatctgcaggatccactcaatcttgaaaagataccgtagaggaatacccgaacaataaataaatcatgttacaactctttgacggcgaagagtgtggctaccgtgctgcaacattttagttactgctggtacattgaaattgggaagatgtccaagagaagaacatgttctgctatcgaatctctcacgatatatatatatatatatttatatgactcacctggtaaaacatctatgtttcgtttcatatgagggcttaggtaccattcttttagagttaagatctcttattgtggaaaaaagaagttgaacgtgatttcatttgtttattgtgctagtggctggaaatatgaaaacttttgctcttgcaacgtacctttttactcaatgtcttatatttgaacactgctatcccagctacgcaacgcattttctgaaggaagagagtttagcagaaacctttctctgtccatcgctataatcagccgtttctttttcgcttccttacgaagtaaagggtgtccctttataacgtaagcgtccaaaatgcagttattaatatactccattgcacgcaaagaaatttcaaggaaagtatccgggaattctgatattttacacttgcactaatatactcttattagaagtagtgatggtagacctcatatcaatctaaacataatggatttccatactgttaaagacggcgatacggaattgaggtgtcctattcccgacacttttgatgcgtcagctataatcaaatcttatgttaaagaagcttctgaacaagggattcatcttcgtaaggcaggtgtagccatggaatgcgtttcagtagaaggtactgctactataagacaccattgaagtcttcttcaagaccaccattatgagaacacttggctcactatacaatcggcgagagatgggctgttattatagagcgtttcaggaaaagcactcctagattctagtcaaggactgcctataacataagagacgagggcacgagatagcgcagtattttatgatgagaatatgaaaataaatacctaactcattgagtaagcttagcagggcaacttaactaacagtcaaaagaaaaaaattaaaaaaaaaacaagagccagcaaactgacattaacattgaccaataaaataagaaaatgtaccagagaattcgattatgaactgatgacaatatcattaaagactttgcacagtattcaaaaactaatcaagagctttgaccaaaaagtgtcccgactttataatgagaccgccgcttaattcataggagttatatggtatgctttggaaagctattacattgtttgataattcaaaaataagccacaatacttcacctattgtgtaccatgtattataagacatcgcagctcgtatctgtaaacatacattgacttacattttagtgataacttgggtacttgagtgaagtccatttctcccgtgcttccggaacataaaccaacatagattctctttcactcgaaactgcccgaagctgttgctctttttttgatcgtggctttaactataaaactcaacagctgcgtgatgaacgcgctgtcaacaaatttcatctttcgaattatataaaaaacactgcgagtgattaaacctcactaaacttgttacgtacctcataacattaatgtgaaatacattatattgaatatgggggaagagattagacttttgtcctctaaaggtcttgagacccatagtagcttttgtttgcccgaggatattttcagaaaccgtttaacatggttgtgcagtgagattcgcaactcaggattttggatctggtcgctatcatggttaccgcttgccgtttggtgggggatggccagtacttggttttatccccttctgacttcagtagttctaatcctggcgctaattgctattttgccagtagttcaaatacagtacagtaaatatactttatcaaatcaactcacccagctttctaaagaaatcatcaaaagtgcaccaggtgcatactctgctgattgggacgctgttgcaatacatttcaattcctacttgtatgaaaacaaagcatggaaaactgcacattttttttttaatggtactgactgccaagaagcattcaggaaaaccattctagagccagctgttttgaggagacaaaaccaagatcctaggttcagttcaattgagattttggtcccttacaccgaagacgcggtgcaggtttattttacaaaagtaaacgcacagtggaggttgatccatggtaagaaggaatgcaaacttactatgttggaaaatgtcaagcttcctaaggaaacctatcgctgcaagctagcatggagttgccagagaatcatgatttctttctctccactagacttccttcctaatctgtctgacttctttatttgtgcaaatttatcaccagcatgcttggtatcttattggctaatagacattttctttagaatgatagatgattttcaaaacataaggcctaaatcgatgaaagttgatgataaaatgcagtacctatcagatattataaacgagcagggtgctagccctgaaaaatgggatacaattgcaaggaaaacgaatacacgattatttgaaaagagggtctggaaaaacgaagagtttttctttgatgggactgattgtcaggcattctttgaacggaactttagtagccttttgttctcaaaaaaatctgcgtcgcctagatcattaaacgttgaactttggaaatacattcaagaagcgcaattgagctctaactatgagccgttaccataaagatagaaacatttattttgacttagaagctacaaggaggatcaactattaatatttttcctagagaacatttttaaaattggatccaataaattagcgccatctattgcccttacacttttctccttcatatctggctagaaaagggggggttacatctcggaatcaaatattttcctctgcgtcgagttttaatcctgcttctggttacattcttttttatcatacacaattctttgaacatcaacttctctcaataccatccgtcttcagcggctacaattacatgattgcaccaaggcattcgcggagaattcacgaatttgcagacgctaacagtataagactcctaacacacgtctaatatcttgtacggatttcaagagatagaaatattacttccatggaagccgtttagagcagactgaatatgggcttagacaataagcttctgaacgagggtcttaaatctaaattcggattttctttttgaccgaaagcggaaacttcgcaggcgcgcaaaaggggtcttcaaggcaccctagcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtgagacaatatcgtaacgtccgttttagtatacgccgctgataagttatattaccgtagaattatttgacatttcgttataactctacaaaaacaacgtacatatcactgtatcgtcttgatgggatgtagtctcttcgtatgagtagtgtcacatacaagattaaagatgcatcagttatgcttttaggatattacgattaggatatgagaatagaaataggatacaattgtatcatagcacccgcatgagtttgagccactaccgtattattgctcggtgaataaagagtgttacgacagtgatgtgacatattattctaatgtatggcctgtgtaagtacgaaatattctgaaatagcatccgttcaagcaaattgcaatattgaggaacttttacgttagtgataccatgatagtgttgctaccacaagccaatatgtttatgtattattgtcgaaaagtagaatatttttatgtttaggtgatttttgtggggatttttctgtaatattgacataagtgtatataaatggagtggtaagtatacggtgtaaaagcggtataacgtatgtattaagagcagttatacaatatttggggccgccaaatgagatatagatattaaaatgtggataatgatgggcgttatgggtaaatggcacagggtatagaccgctgaggcaagtaccgtgcataatgatgtgagtgcatatttactgatttagtgagtgatgggccatgaagtggaatgtgagagtagggtaagtttgagatggtatatactgtagcatccgtgtgcgtatgtcataggataattaaaggatgagtatggcatgtggtggtagggtaagtacgtgtgtattatttacgatcattcgttaacgtttcaatatggtaggtagaacaacagtacagtgagtgggacatggtggatggtaaaagaatggtagggtaagtggtagtggagttggatatgggtaattggagggtaacggttatgattggtgatggtatggttaagtaggacagggtaacgagtgagtgggtagggtaatggagggtaagttgagagacaggttggccagggttagattagggtgtgttagggtgtagattcatggtacccgctgctgaaaacctatctccgatacctgcctctattgatacgaacgacattcctttaattgctaacgatttaaaattactggaaacgcaagcaaaattgataaatattctgcaaggtgttcctttctacttgccagtaaatttaaccaaaattgaaagtctgttagaaaccttgactatgggcgtgagtaatacagtagacttatattttcatgacaacgaagtcagaaaagaatggaaagacactttaaattttatcaataccattgtttatacaaattttttcctttttgttcaaaacgaatcctctttgtccatggcagttcaacattcttctaacaacaataagacctcgaactctgaaagatgtgcaaaggatctgatgaaaattatttctaatatgcacattttttactcaataacatttaattttatcttccccataaagtcgataaagtcattttcaagcggcaataatcgctttcattctaatggtaaagaatttttattcgcaaatcattttattgaaatcttacagaattttatagcaatcacatttgctattttccaacgttgtgaagtaatattatatgacgaattttacaaaaatctttcaaatgaggagattaatgttcaattgctattgattcatgacaagattttggaaattttaaaaaaaatagaaattatcgtatcctttttacgagatgaaatgaatagcaacggaagtttcaaatctattaaaggtttcaacaaggttttgaatctgattaaatatatgctgagatttagcaagaaaaaacaaaattttgcgagaaactctgataacaataatgttacagattatagtcagtcggcgaagaacaaaaatgttctcttgaaattccccgttagtgaactgaacagaatctatttaaaatttaaggagatttcagattttttaatggaaagagaagttgtccaaaggagtataattattgacaaggatttggaatctgataatctgggtattactacggcaaacttcaacgatttctatgatgcattttataattagtaagccgatcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaaatgttcagcgaattaattaacttccaaaatgaaggtcatgagtgccaatgccaatgtggtagctgcaaaaataatgaacaatgccaaaaatcatgtagctgcccaacggggtgtaacagcgacgacaaatgcccctgcggtaacaagtctgaagaaaccaagaagtcatgctgctctgggaaatgaaacgaatagtctttaatatattcatctaactatttgctgtttttaatttttaaaaggagaaggaagtttaatcgacgattctactcagtttgagtacacttatgtattttgtttagatactttgttaatttataggtatacgttaataattaagaaaaggaaataaagtatctccatatgtcgccccaagaataaaatattattaccaaattctagtttgcctaacttacaactctgtatagaatccccagatttcgaattcaacaggcttccaatgctcttcaaattttactgtcaagtagacccatacggctgtaatatgctgctcttcataatgtaagcttatctttatcgaatcgtgtgaaaaactactaccgcgataaacctttacggttccctgagattgaattagttcctttagtatatgatacaagacacttttgaactttgtacgacgaattttgaggttcgccatcctctggctatttccaattatcctgtcggctattatctccgcctcagtttgatcttccgcttcagactgccatttttcacataatgaatctatttcaccccacaatccttcatccgcctccgcatcttgttccgttaaactattgacttcatgttgtacattgtttagttcacgagaagggtcctcttcaggcggtagctcctgatctcctatatgacctttatcctgttctctttccacaaacttagaaatgtattcatgaattatggagcacctaataacattcttcaaggcggagaagtttgggccagatgcccaatatgcttgacatgaaaacgtgagaatgaatttagtattattgtgatattctgaggcaattttattataatctcgaagataagagaagaatgcagtgacctttgtattgacaaatggagattccatgtatctaaaaaatacgcctttaggccttctgataccctttcccctgcggtttagcgtgccttttacattaatatctaaaccctctccgatggtggcctttaactgactaataaatgcaaccgatataaactgtgataattctgggtgatttatgattcgatcgacaattgtattgtacactagtgcaggatcaggccaatccagttctttttcaattaccggtgtgtcgtctgtattcagtacatgtccaacaaatgcaaatgctaacgttttgtatttcttataattgtcaggaactggaaaagtcccccttgtcgtctcgattacacacctactttcatcgtacaccataggttggaagtgctgcataatacattgcttaatacaagcaagcagtctctcgccattcatatttcagttattttccattacagctgatgtcattgtatatcagcgctgtaaaaatctatctgttacagaaggttttcgcggtttttataaacaaaactttcgttacgaaatcgagcaatcaccccagctgcgtatttggaaattcgggaaaaagtagagcaacgcgagttgcattttttacaccataatgcatgattaacttcgagaagggattaaggctaatttcactagtatgtttcaaaaacctcaatctgtccattgaatgccttataaaacagctatagattgcatagaagagttagctactcaatgctttttgtcaaagcttactgatgatgatgtgtctactttcaggcgggtctgtagtaaggagaatgacattataaagctggcacttagaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaaccctagaagtattacgtgattttctgccccttaccctcgttgctactctcctttttttcgtgggaaccgctttagggccctcagtgatggtgttttgtaatttatatgctcctcttgcatttgtgtctctacttcttgttcgcctggagggaacttcttcatttgtattagcatggttcacttcagtccttccttccaactcactctttttttgctgtaaacgattctctgccgccagttcattgaaactattgaatatatcctttagagattccgggatgaataaatcacctattaaagcagcttgacgatctggtggaactaaagtaagcaattgggtaacgacgcttacgagcttcataacatcttcttccgttggagctggtgggactaataactgtgtacaatccatttttctcatgagcatttcggtagctctcttcttgtctttctcgggcaatcttcctattattatagcaatagatttgtatagttgctttctattgtctaacagcttgttattctgtagcatcaaatctatggcagcctgacttgcttcttgtgaagagagcataccatttccaatcgaatcaaacctttccttaaccatcttcgcagcaggcaaaattacctcagcactggagtcagaagatacgctggaatcttctgcgctagaatcaagaccatacggcctaccggttgtgagagattccatgggccttatgacatatcctggaaagagtagctcatcagacttacgtttactctctatatcaatatctacatcaggagcaatcatttcaataaacagccgacatacatcccagacgctataagctgtacgtgcttttaccgtcagattcttggctgtttcaatgtcgtccattttggttttcttttaccagtattgttcgtttgataatgtattcttgcttattacattataaaatctgtgcagatcacatgtcaaaacaactttttatcacaagatagtaccgcaaaacgaacctgcgggccgtctaaaaattaaggaaaagcagcaaaggtgcatttttaaaatatgaaatgaagataccgcagtaccaattattttcgcagtacaaataatgcgcggccggtgcatttttcgaaagaacgcgagacaaacaggacaattaaagttagtttttcgagttagcgtgtttgaatactgcaagatacaagataaatagagtagttgaaactagatatcaattgcacacaagatcggcgctaagcatgccacaatttgatatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagtttcgatattgtcaataaatcactccagtttaaatacaagacgcaaaaagcaacaattctggaagcctcattaaagaaattgattcctgcttgggaatttacaattattccttactatggacaaaaacatcaatctgatatcactgatattgtaagtagtttgcaattacagttcgaatcatcggaagaagcagataagggaaatagccacagtaaaaaaatgcttaaagcacttctaagtgagggtgaaagcatctgggagatcactgagaaaatactaaattcgtttgagtatacttcgagatttacaaaaacaaaaactttataccaattcctcttcctagctactttcatcaattgtggaagattcagcgatattaagaacgttgatccgaaatcatttaaattagtccaaaataagtatctgggagtaataatccagtgtttagtgacagagacaaagacaagcgttagtaggcacatatacttctttagcgcaaggggtaggatcgatccacttgtatatttggatgaatttttgaggaattctgaaccagtcctaaaacgagtaaataggaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcacaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaaatcgaagctgtcttggctggtgtagaggcagagaaattagctggtaatgcatcctggggtgaattgtttagtagcaagacaaaggtccttcaacgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatgctattatttgaaaaccatttaatggattacagaaagttgcaagctattgacaaaaagaggagcaaagaagccaaagaattgtataaccgcataaaaccttttgctcgtgttatgactgcacaggattttgaggaatttagcaaggatatattagaagaattgcattgcagggcaagaatacagcaattacaagaatggagaagcaatgggttaaccacgttagaagcaggtcttaagtatgaacgagataagcaagctagaattagcagtttcgagaaatttggcgcttctacggcggcgtcactcagtgagggcaatagccgttataggtcgaattctgcacataggtcgaacgcagaatacagccaaaactacagcgaaaatggcggtagaaagaaaaatatgaccattagcgatatacagcatgcacctgactatgcactgttgtccaacgacgagcagcaactttgtattcaactgaaaattttacctaaaccgtatctcgttctaaaagaggtaatgttcagagaactgttgaagactgggggtaatctaagcaaaagcgcatgtagggaactacttaatatagaccccataaaagcgaatagaatatacgattttttccagagccagaattggatgtaacaaaaaaaaattgaaaagtaactacaattgtcactagttattattggccaagtcataaagggaccttgtctcgattttatataccgtatatcggttctttccaactaccaccatccaccgcccatcataaccgttaccctccaattacccatatccaaccccactaccacttaccctgccattgccctaccatccaccatgtcctactcactgtactgttgttctaccctccatattgaaacgttaacaaataatcgtaaataatacacatatacttaccctaccactctgtaccaccaccacatgccatactcaccttcacttgtattctgatcggtcatacgcacacggatgctacagtatataccactctcaaacttaccctactctcacactccaatccatggcccatctctctcactaaatcagtactaaatgcacccacatcattattcacggcacttgcctcagcggtctataccctgtgccatttacgcataactcccacgattatccacattttaatatctatatctcattcggggggcccaaatatcgtataaattcccttaatacatacgttatacctctttttcaccgtatactaaccacttaatttatatacacttatgtcaatattacagaaaaatcaccactaaaatcacctaaacataaaaatattctatctttaaacaataatacataaacactttgacttgaagtatgagcactaccatgacgtcattaatgtaaaagttccttaatattgctattttcttgaacggatgacatttcatgttgaatgtggtaacccaatagcatgatatgagtaatgtttagacaaagaaaacatatagtagtaaacgtttaatccggtagtacttaagaaaccatagtttctatgtgcaaaaacagtacctaggtaattattacatttacataacatatagaaaggtccaataaacttactacattatgatatataaactagatcgtaattcataacgtcaacacccaaaagcatgatacgagtaatgtttagtattttttcagtattgtttcaataatgcggtacagaggaatagcatacagtaacaaaatcttcaatcaacttgcaaccaaaaaaccctcagtttatatgtacaaaatagtaattccatgtatcttcctttttggtgagatcaaagttttcaatagttgaacctaaaacaaaattccacgatatgaggagactatcacccttcctagagataaaattttaattagcccgtctactttctcaaaaattacagaggaattttctgaagctattaatagaagtaagcagctaaaggcttaatatgaaaaaacatacagcccgagcctgtactaaatgtaacgtaaaattttgcctacgatcttgttatatgccatgaaaagtttcttttgatgatgacaattgttttaagctagcttttttcggtaatactacgaaaattctaaaatgatcagtgtggataccgaactataaatagggatgaatggagtgaacttcaagtactgatgcatttgctaataactagttgctcacatttaaagttctttgtcgtttacaggcaactgtttaccaacgctggacagataaacatctagaagtcaatgtttggccagtaatgcttttctaattttttttccagtaattatgatggcattacgtataaacggagagtgatgacgttttaaaagtcatttgatcatacgcagtttttcacttcgaaatttatagcgctaattctctcctataggggcatatatgaagacagttagactgaacaaaagaatttaaatcttgcgtatgtaggtctttagattttcacagttgatgtttatcgctgcaaatttatataaatcatcatactgatactgctataatatttccttgttcaatattaagtgatggctttaagatagtcgttttttacagagctttaggcaagaatctgagtttgagcgttacaaaggtggttgcttcaggcatgtacctgggaaatgaacctaattgtatctttatatttttaaatagttatgaggagtgagatgcattattatatttattatagagtgaatattgaggactgcctcggatttaacgcaccgcaagcgtatattctactatttaattatacccacttttgtaatataatcattaatacaatatgtttttattaaagagagtgaagagaatcgaaaacctaaagagtagatttgaaatctaatagtttcaccttaaaacacatctccttttaaaacttattgtaattattcattagaatttttatatttaattaatctatcctttttactaatgaaaaattctttaaataaaaaaatctatacatccactagaaagtatatataaatttggggtacctgcaatctttatttattttatttgaagtaataggaattatttatattattgtgataagaagtagtattctattattataactatattaataaaaaattttattttctattgaaaaccaattttttacaccaaatatcagacacgctttgtctatttctatcatatagcgactgtgatataatgcgcgcgtgttttgaacggcatttttttagcctgcgaatatggatagatgatggttttaggaaacatatgaacgaactaccaggacgtaataactgcaaaataatgtctcctgaactacatcgccataggcatggatggagccaaatttgaaaatactgtagcttttttaccatctgaaatatttgattgctacaattccacgctacccaagaatgtattccgaagttttgttacctggtcctgctatgagaaattcaattccttagaattccgcacttggctattaatgtggttaccactcattattgcgtggaaaatacgtggtaaaagacactatctcgttatcgttactgctcttatgtttgaagtgctgtatttcttatggacatattcgtacatattccgagaacgcaccttaggaaagcaagtttctcaatttgctaaagagatcattacaaatactccgggtatagacactgaagactgggaacgtgttgcagtaaatttcaattcttatttatatgaaaataaactttggaatactgagtactttttttttgatggttccagctgccaagaagcgttcagaaagatgcttcttgagccattttccttgaaaaaaaaatgactttgctaatgccaaggtacctgacggatctgtttgttacactgaaaaagctttgcaggtttattttacacagatagagagaaaatggcactggattaattctgaaggatttttacacaataaaaccacacagagtgttcaattttcgaaacatggttacggttccaaacttctctgggctttcaaagaagtgacaataatgaattcacgctttgcgttcttcagtattgcttacttaaacggtctccttactataccaagactaagaaattcactgcatatcctctatgtatgtgcagttctttcatctatgataattgaatatttaatagggatcgacaaattcaggttcaaatcaatgaatctgatacataaactacagttcttgtcatatattacatgtggacacgagaagtctgatgaaactaattggtctcaaattgcgaagaggacgaatacttacatgtttgagcagaaaatttggaattcgccaatactgttctcagatggtattgattgtgaaaagttttttaaatggtatttcagtacccctgtatcttcgcaagcgtctttgtcagttggttccactgattttgaactctggccatatataaaagaagcacaatcagcttgcaatgatgtgtaattggtaaagatattgatatactattcttaaagaccaaaaaaaagctgttaataacccaagtttaaacattagtagataatgcaatatttgatgaagtctgtagagtgccactatacatcgtaataaaattacacagtacgtgcttgtacggtcgccatatcatgagattacttgaagcttccttgaagctcataccgtaaccagttttatacgtttttctttcctcataccaacatcctttaacgtttgttgagagaaaatgcggtagtttttgtaaaacaccttacgtgaaagatattattactatttcaagaccaaacgcgtaacgaatgtatattctagtactgcgttaaggtatgagttacccataataaattttattactattaacattttcttggagtacttcgttttcttacttgatgtacgttgctatacagtacgcattaaagaaattgcagctatcgtcgtgtttggttcatacggttgagttaatatttcaaaataatgtccgtaataattattaccgacatctgtctgccttttattaacatatctcgcgttcaacctgcgcgttgcttattgcttgagtaggggcgaaacacctgttgaaatcttacggtgaactttcactatttaaaggactgcttttctccaagagtttttattatacagaaatatcgtagcagtatcccagcgggagatagatccttttcagaaattaacgttcatgactggtcaagagaaaataggcgctaagcgttttcagatctgctggagagtttggagacgcaatatactgctattcatctttgtatttgctgtttccttttattattttcgttcaagagatgcagaagctatagttaatactacggtaattgcctcacctgtggtgactagttatctaatgaaaggcaaaactactattgggcgttagcaggtggtgccagtggattttcaattacgctagcaggactctccggtgcatacgccgctaacaaatgtacagcagattcaggtagtactcatgctggactggagctgtagttacattggtagcagatgctttagatggagttgctaccactgctgatacgattgctggggcagcggctttgacggcagcagcggcaaaaaagatctactggatatattgatactattgctggattagacttccattcttcaagtcctcgtaatttcactgcaatcaacaccaccatgcaaacagttggtcttgtattatcaggagcatttgactatatgaacacatagaaggctaatggcttagaaaagagagaacaaaataacacagttacagaaatgcagcatgtttgatattttagtagtcagttgggtcttcatgtgccactcacatgcgtaataatgtgactgaattggtcaacagtataataggtgttcaaacacctggatcgctaccagatactctttctggggcacattcattgcagagacgcataagctattttgacgtcaattggatatcatggaattgggacaatgtaaatgttgatcttaataaagaggtaaaaaaaagtaggcccctccttggggaggaggacgatcaatgcatgttcggttggttcgcaaataatccagggtggaaatattactggtcggtaactgataatcctgatccaggatataaagagaattactctgacattggagatgaaaatgctgtccacggtgaattatattttaacacatatggggggttgatggcttctgtaatgacaacaaagatggtgctcaatgcgaagagacagcttgtggttattgatacaattgtggtaacggccatctgcgattatgttatgaaatattggaaaaaaaaggttaaccttactacgatatcattatatttgatgttaaagttataaagccagacattttcaatctttctttaaatcaatgaaagaagatgcgcaaatattgaaagcattgactactaagacttaggaaaaagcttctgttgacgatttataatgttatatcaaataattaaatttatttcctagatttttgaattgtgagagacatccctagcatgattttttttcacatatactttcaattttaatagaaatggagccgtcaaatttaacttattttctatttttataattgaaaattttatttattcatctattctacattttattttggtgttgggatttttttccggcttaaatatatggtcagatcttttatttatattacacttatctacaatttgtatttatatcatcaaaaagagctttttatttctatattttatttttcgttacttaccaatgtctatagaatttcgttcgtaaaggcgtttgtctctagtttgcgatagtgtagataccgtccttggatagagcactggagatggctggctttaatctgctggagtaccatggaacaccggtgatcattctggtcacttggtctggggcaataccagtcaacatggtggtgaagtcaccgtagttgaaaacggcttcagcaacttcaactgggtaggtttccgttgggtgggcggcttggaacatgtagtattgagccaagtgagctctgatatcagagacgtagacacctaattcaaccaaattgactctttcgtcagactgagctagagtggtggttgcggaagcagtagcagcgatggcagcgacaccagcggcgattgaagttaatttgaccattgtatttgttttgttttttagtnnnnnnnnnngctggtataagcttaataggaaagaaagaaataaagatatattctcaaaagcatacagttgaagcagctctatttatacccgttcctctatcagtcatcactacttaaacgattcgttaacagatgctcatttagcacctcacatatcctccatatctcatctttcacacaatctcattatcactatggagatgctcttgtttctgaacgaatcatacatctttcatagacttcgtatgtggagtattgtattatggcactcatgtgtattcgtatgcgcagaatgtgggaatgccaattatagggtgccgaggtgccttataaaacccttttctgtgcctgtgacatttcctttttcggtcaaaaagaatatccgaattttagatttggaccctcgtacagaagcttattgttaaagcccatactcagtctgttctaaacggcttccatgcaagaaatatttctatctcttgaattcgtacaacattaaacgtgtgttgggagtcgtatactgttggcgtctgcaaatttgtgaattctccgcgaatgccttggtgcaattacgtaattgtagccgctgaaggcggatggttttgagagaagttgatgttcaaagaatcgtgtatgataaaaaaaaaaaattgtaaccaattcgtaaatactgaaactctttgcagtaagaaatctttcattcccagagagaacgcggaaatattcagcctaagtctctccaaattgatttctttcattttggtagcgaaagacttagtatcaacctcaaaaagctgaaatttttgtagatatatgtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttagaaactataacggttcaagacattcaacactataacatagcttggctggcttgaacaaaaagaggaagaagcaaaagcaagagtaaaaagcttctcatatatttctggcattgttgatcacccagtgcaagcccaatttcgcctgtgcttttcttaaattgtttctgacaacaccgaggttttcgctgcagaaaaggaacatatggtggtaatttgtataaggggttaagggtccaaaaatttgctaccctatcgctcactatagcaaaatatctcgagagatatccgaggagttaaaactgactagacctgttgcgtaaacctcatgcaagcagtactcttcgaggatttaagctttggaactgctttcaaagttgagagtatataaggtgttatgatcttggaataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcacggcaacattcactgggcctcgttctactaccacctcaccagagcttataacactgtccgctcttataggggtaaattcaatgcaagaaactcatctacttttaagaataacgcgactttcttcaatgacatatacgtattagaaggaacctatggtacggacgttgtctctttaaagaatttttcaccttaaataatatcattgttggcctattaaattataaaatgggcaatccaagtggcattttaggcatatcccttccccttgcagaatttacagataatgttgaaaatgcatttgctttgaacagaaaactcttcgtatatgagaaattctaatggcatttgaaagacaaggaaagattgaaaagaagatatcttattccttatttttgaatggacctaatgtacactttgggagcatcttattcggtgcagtccataaaagtaagtacgcagaatagctctgcacacatcctatgcgtcaagcttataatacccttgattcaaactcaagaataattatcacagcacagagtgttgcaattttggacggcaacttgtatggtaaaagtgttgtagatattcagtttccagtgctattagattccggtacatattctgtttacctacaaaatttgtaaattggattgttaagagttttttaattggaaatataactctgatgatcaaggctacacctttgactgctcaaaagtcaggatactttactgtgtgtcgactttgaatgacttaatatattgaggttatctccgatagtgtcccagcgccacccctgctccaggatactccagtatgtcggtatataagtctggtagtcccatcgggacaggagattttattaatgtcagctgaacctcgtattcagaattttcgcagtacacatcattgcttgtcactgcaatgcaaggcgatggtgttagttctttcccaagtgggggcagttctaggaaaacggcccctaaaaggaaaataaaggttacatatatcgttcttcttcttcctattcattgctgtccttcacatcttattttctttcataaataaagaagagccatatagtttcgcattgtgctactgtgtaagacagcaagttttttgatagacaacaagaggagctatagtggtaatacgagttatactcataaacctatctcctattcgtatttattacattgtacactgtagcttcatatacaaattatgagcttataagggaggattatacatttttggaaatattattgctatgaatagataatgtgatgagttttacaagtgtaaaattcttccatagagtttgagggcaatcccaaaatttccgaaggtccttgataaagtattacagcgaaaacatatatgaaatgttccaattgagatatctcgcttatattaatacaccttctttcttttaccatatattttctaattggccgctcagctatagcgatctttacatatatacttcgaagtttttttaaacagtgcacccgtgcatcatacatcatgcaaggtacctttttttctcaaaggtattgtcttcaattgaagtgccactatggcatgatgaaccctgagcatttctgaattcaacagaaccaaattgtccagaaataaatctgtccgacatgaattatgaaactttttttcaattaagttaagagaattttgcagtgtcttaccattattttgacccattggctgcatgtttgtgctttgacttcgagaaccatgttaaagcttacttgtacgacgaccaatgaagtacataatggcagttttttgggacgggtcaaaaaaagtgttgcacaatcaaatcaggaacacataaaatgttataaaaaaaatttgtcttagtatcacctcagtggttattcattacgtactattgtgaaactattcggatctttcctaaacgggcttttgaattagtgttgcttctattcctggaatggaaggtagtactatcatgtactcttgcttctcgaagtttcaacaatgaagtcaaaacgctgtcactttcatatccacctacagaccctgcgggtcagtaattttttttcgaataaccgctgaggttggaaatatagaaacatattccagatctgtattttcagttgctagcaaaaaggtaaatattttcgttcaggttttcagcatataacaagtatagttgatatataagcgtcctaattttcattcaaaatggagagctactgcttctgatagatttgtgcaatctcaagaaatcaagaacaacaaccatatcatgagtttcctaagcatttttacttttttcagcgtccttgtttctgttgcaacagccgtcagatttgatttgactaacgttacctgtaagggcctacacggacctcactgtggtacctacgttatggaagtcgttggtcaaaatggaacatttttgggtcaatctacgtttgttggtgccgacgtcttgactgaaagcgctggtgatgcttgggcaagatatttgggccaggaaacaagattcctcccaaagttgactactgttgctagtaacgagacaaagaacttttctccactcatcttcactaccaatatcaacacttgtaaccctcaatccattggtgatgctatggttccttttgctaacactgttactggtgaaattgaatataactcttgggcagacactgctgataacgcttccttcataaccggtttagctaaccaattgttcaattctaccgattatggcgttcaagttgcttcctgttacccaagttttgcttctgttatcttaagcactccaactgtgaatattttcggtaaggatgacacattaccagattattgtaccgccattcaactaaaggccgtttgtccaccagaagctggttttgattaatcttttctcacatcctgacttatagatttttttttgatcatttttagttatagacaaaatcttttgagaaagccatacggaagttatttttaactggaaagtacaatcaatttcctttaggcatttctactttcttctgaccctgatttaaattttttcgagttctttttggtacgatgtgttatttattgtcgatttattacgtataattctttataatataaaagtgcaatacagtgcatctagatatgaattttcaaatttttgcagaatacgattggtttgcctacaggatagaagtaaattattcacaatttccaacatttaaaagtgacgattgcatggcaaaagcgttaaaaatgatgctacatctcacatgagagtggttcgattatgttgaatttcaacaccaattcaatatactttgatttaaacacacatttacccgtatgatgccggagatgcaaagaatccgaaaggttttagggacatcttagtggaaaatcatcttggcgtggccgggagtaccagattttggatggttccttattgcagtcaatttggatttttgctggcgttgcatcatggctatgttatcccatgcattccaagagtgctttacttaaagagtagcttcgttacaaaacattacgttatacttcatatcgataatatttcagatatcaaaaattatactacattatacaacaaaaccgtgtaggtttgcctatcacttataagactagaacaactcttagtcaaatatctttattccatatgtcaactatttgtgaaagccggtgcttttcgtcttctttaaatttgatcaactttccaaactctccttccttgaataatgtgcaataattgaacaaaaaacactctccagagttaatccatcctgatatactagtatctggtattataatcccttcaagttctactggtgatgcataatattcacgtaattcatctgcattttggaacatatcatttagtctctgtctatgctcataatcatattcccatgaagcttttttacaaatgttaaggcctccgtttagccatagtaaggacccgtccctgtctgtatgagatagttgcacagaacaaatctggtaaaactcaccagtattctcttttgaaactacgttgcccaaccgaccaatgtttgatgcatccacaggatggaacgtaaagcgattgttcgaaagcaactcgcctagccaaaaaaagtccttatcaccatgaaaatattctgcaattggagaaaattgtaaagctatcgaagtaagcatactgaagagatgctttcctttatgtaatactaccaggccgctttctaaatgatgtttatatttctttataaacatgttttccaggacctgcgcaaccaccggatcctctacttgctcatgtatcttggattcatcctctaaatcaagcccaatacacccatagataatttcccttaaaatttctaattcagaggactcaaatagatcatctgatattacccgatctttaaagaatagaacaccagtcttttgaaattcctttaattcataaaatttttctattgaaacaaagggcactgtatctgagtccattagaataggagtttcaaaggatgagaaggtcaatgctaaccacttgttggaataggtggtaaattttttcgaatatttcgggtttagcagactatgtacatttaaaaaccatagttcttgagcaggatattcagcggcgtctagacttctcgcatatttgataatagatttcatggaatcttgactcagatctgcattatgaacaatctgtataggataatcatttttgatgaacctcaacactttcaataagcgtatggtttcattcaactgcacgtcagaagcactaataactatgcctttcgaaccactttgagtcacagtgtgcaaccaattctcccaaaaagatagccctgtatcgaaattgatgggcttagaacgaaggaattgatggtttttggggtcaaattccaacacagacgcatggtaaacctcgccattccatctcgtagttgtgtgccagaaggcactttcatcagtttctaatttttcaaagttaatatacggaaagagcttcttttcaatatccctcaaacgctgaatattatgcccatcaacctgctgcaagcaattaaaaaaaatcttaatcctcgtaaccagttcaatcacatcttttgcaggattcggggttatttgatttacgtcgtagaagtcattcaaccacccaggcgtaagaccttcatagtaactccagcagccaccattgccactgctgctactttgaactggttctaccaaatctaacgaattcaactgagagtaatatactactaacacaattcccagtagtacaactaatataaacagtcgattttttcttctcatattcgataaatactattggggctacttttgtcctgtcactgcggatttgcaaacactcatgcgaatattttactcaattgagagatttgctgtctccccccacttcgatggtccccacccctaaagtaaaggaaagaagaattagcactgttttagttccaggtacttctttctttctttaccggtattgtgtggctcatcaaaacttcgtctcgggaaaatgaaaaatgtaaacaagaatttccgtttcaaagagttgcctaaggcccactaataatgtacttattatttacaattcggagaacgctgctgatagaaatcaatcaagaagtcccttagtctttgtgtgtttacgccatattgcttagtttcgtagtgcgttacagttctatcgtgtgaaaatttttttctaatgcatcagctgttatgcgcactacttgaaaggttatcgagcgtttgtaaaaagtagaagtacttaaatgaaccttcacggttaagcaaccagtataattgaggctgctgatttgaaattgcgttttgtgttcagaaggatccccggaggccttcaatgagcttccaatttattttctccaaggaggccattttttgtagtgtgatgttgacatggttataactgttagcagtgtttgtgatgatggctgtagtatcaccgcagtggattagctatagaaaaaaaaaaaaagaactagtttttagttcgcgcatcacgaggtacgtgtttaatatgtcagatgcttgggatcacgtatgccgttaactctacaaagcaattgatattttgctgcctcaaatatctcacactgctaggatatattcttttatcaaacagaaaaaaagggcagcgtaccaacatgtataaaagggttattagcatttctggtttattaaagactggagtcaaacgtttttcttctgtctattgcaaaacaaccatcaacaacaagtttacatttgcaacaactaatagtcaaataagaaaaatgtcttccgttactgggttttacattccaccaatctctttctttggtgaaggtgctttagaagaaaccgctgattacatcaaaaacaaggattacaaaaaggctttgatcgttactgatcctggtattgcagctattggtctctccggtagagtccaaaagatgttggaagaacgtggcttaaacgttgctatctatgacaaaactcaaccaaacccaaatattgccaatgtcacagctggtttgaaggttttgaaggaagaaaactctgaaattgtcgtttccattggtggtggttctgctcacgacaatgctaaggccattgctttattggctactaacggtggggaaattggagattatgaaggtgtcaaccaatctaagaaggctgctttaccgctatttgccatcaacactactgctggtactgcttccgagatgaccagattcactattatctctaatgaagaaaagaaaatcaagatggccatcattgacaacaacgtcactccagctgttgctgtcaacgacccatctaccatgtttggtttgccacctgctttgactgctgctactggtctagatgctttgactcactgtatcgaagcttacgtttccaccgcctctaacccaatcaccgatgcttgtgctttgaagggtattgatttgatcaatgaaagcttggtcgccgcatacaaagacggtaaagacaagaaggccagaactgatatgtgttacgcagaatacttggcaggtatggctttcaacaatgcttctctaggttatgttcatgcccttgctcatcaacttggtggtttctaccacttgcctcatggtgtttgtaacgctgtcttgttgcctcatgttcaagaggccaacatgcaatgtccaaaggccaagaagagattaggtgaaattgccttgcattgcggtgcttctcaagaagatccagaagaaaccatcaaggctttgcacgttttaaacagaaccatgaacattccaagaaacttgaaagacttaggtgttaaaaccgaagattttgacattttggctgaacacgccatgcatgatgcctgccatttgactaacccagttcaattcaccaaagaacaagtggttgccattatcaagaaagcctatgaatattaaaaaaatcgaacgaactcataaacgtcaattatgcgtgtgccttatttatttagttgtgcgtacagtataatgcacttatttatttaccaatcaaatgatttttttaacttttcacgatctatataattacgttaatttcgagtatataacaatgaaatatatatctacgttgtcttgaatggaaaaaagaagaattgaagctctattaatgagccgagaccggtacgtttgttgaaaatagtttggatttaattgctgacatactgttggctttgaagcatttaagattgaaaaatagtcatgtaaaagtcatgctttaatatggtgggcttcatgttggatgcaagaaataaaatgaaattcgaaggcctttcgcaattaaacaaggcatcgtcaaccagacaatgtcgaaaattttgagtcaatctaaatcaatccaccgccacactgaattatgccaatgatattgtcttcctttttttggtttgatatctctaatattcaacctgttataagcaacgtcaatccgattactttcgtctgtcattcacatgcgcatattttttttattcgttttatgatatagctgtctttattacaacctcgaaacacaacggcaatgtaaccttaccagccgcaatattacaaggagcccactttattttcaattgctatcgctacatcgcaaatactacagcaccccatcagatcttgaagtatatatatatatttagtaataaatacattattggaatggctagtaaattttgacataaacatgatttccgaacgaattaaaatacagctgatttaggagaaagtatcagtacattgctaaaaattttaagcaaatgttaagttaaaaaggctcatcattcagatgagcttaagaatatactttttgcgttattcaagagtgatgattagtgctgaaatactgtgacgatatcagcaatatgtctgataaataaatctgtacattcctggaaagtaatatgtacttttcaactatttcaaagagctaatgatatttatttgatctttatatcgacagatgaatctttttcatagaagccgttatgaagacgccaaataacaatactcaagatatactataagatcaccgaccaggtacataatacatgacacagcacaaataaccgaccaactgacaatagtagaaagtagcggacggtgtcacacggttttctcgtccacatcactggaagtaagcaatctcttggccagctttcggtgatccaaatattatatcagaccagtttcattattctcggaagtagagtcaaatatttcctattgtatagtgctaatgctatcaatgtttattatatacaacgtacagtagtattattctctaagatcgttgagttgctcatgaggaaattcgaaatattgtgaacaataaattatattatctttttgagacgatgaaatcttaaaaattgtcagcaaataaatctttatttatcgattactaggtcgaaacattttttttgtttattcaaaatgatctattcccttcttctcgccaaagtattacttaaaatgtactgatagttttctaatgatgtacttctataactaaaccataataatgaaaattacaggtaatatttatatcacaagcaacgacccctcttttctgtttttatatagtaaccattaagaatagttggctaatatactatgaaagttcttaattaaaaaaaattcatgaagagttaatcaacgttccagtaccaaatttattctatgttctccttggaagatgaacttgccgcagtagatcacagaacctcattttcaacgtttttcaaagaaatactttattgatttactgacaaatattaatacagtctttatatcatcaatatgactaaagtacatgggaattgcccagcagtagagctcgtgatcgaataggaaaacgaggactttcagtaactcgtagacataggttaagatcatggatcctgcattaaaaactgcacatagcgctagaattttgttagcgtatctgcctgtttttctttcaaatgtaaaattttaaatgctatcatcgctttggatactcagcaatagtgcgcaccggttaaggtctgtttttatggttaaacatgtcttgatataatgagcattcttttatgaaacttcaatgcacccaaatgtatatgttcagacagtttgtcaatagagtattaatcattcaaacaaaactgtaaatttgtatgttagatgtagctttaaagaaacttgctagatctaaatattaatagaaaacatctaactatcaattaaacgacatcttacatttcaatttcataaaaattattcttgtggctagtttatatcatatagctttccgtaaaaccggtaacaagtaatacactaaattgtccatgttttaactatcatttccttctaatttttctcctttcttagctgatttaattcatttatttgctgtcgtttgcatttactgactaaaaaaagtgtaaaatatgggaagcgcaaattgaaaagtcgggttgcgaaattacctgccaaaaatccacctcgttaatatctaacaagattcaacgcctgttgacgaaagaaacttgccagtctcccagtttacttctatgtttaacataattgctatgatccactctagattctgcccagccgtcaacttcacgcccacgttgagagtacattcagtacgttgaaaatacattcagtcacacccgctgcacagcaagtcgtttcatctaagctattttgatcgttagaatatccacacctcacaagtatcgacaatttagatgtgtattgggttttgtctacgcaaataccattagtttcacataagacgccatcagcgctactgtaaatagattgttcctctgttatcgtgcgaatagaattagaaaaccaataatcattgaataatatatgtgacagtggcaggccaccagaataaagctaatatctagaggggtatttcttcttgagtgaagaagaaatatgctgcttccaaattttaggacgacaaatcctcataatatgaattaagcagattacagaatgaagggggttgaggagtcccgcagcacatcgctccttcgctaagagctccactgttgaaacgaaaaaaaaaagtattaatcaatggtactactatgttctttgttactaaacgcgcctatttttttcgagagcctttacgacagtcaatcaagcattctcccgcatacttcgctaagaaaaaatggtctttaattgggcccttcatctacaatttttgcttaagtggcgtaacttattttatcattccctctccctgccatcctctttatctttgttctatatcacagcagctaattcagtttccattcaaagtatgccacggataacttgatgcttcaagaagaaaaattatttggcctaaaacttgctgtttcttcacaatttttctaaatgctctccgattcccggattgcagatgtttcactgctccacatagtatcctttgtgtccaccttgataatcgatactttaaagattattttgtgggaggagagccttagaaagagtacgcttgttttaagaaggaaaacaagcggcaccaatcttcaattggtattttaaaatctattagacgtcaaatcccggttagacttgagatagatgtacctggagagaaaatctataataaaaaaaaaaaatactttcaggtcagatatttcttttttttgtccctaataaaaagaaatggtattctgccaaacaccaaagtgccaaataagcattattttacatagtaaaaaaatggaaattacgtcaattatcgacattatgacataaaattggatttaacaacatctctgaatctgatatgcttctttcattagggtggaaataacagcatttgagagaagcaattgccaagattctatgaaaattttctagaaggcaagagtatttcagactttcctaatatgaaaggacaaattgacactaatgtctgattatggccaattcctgcggtaaattacacggcgattacggcgacatgagctcacattcatcactctatgggacaaatgtttccaaactgggcgcaacaaacacctgatgtgactcctaccctttggacaatgcagatccacgctacggcaaattagtcaaatgcactagaacatggcgcaagtacttattgtgacctttggggtaccgttaccgtcagttttcttcagctaaggcgcgcgcgccagataacaaaaaaaaaatatagttgctgcttaaaaaacaatacacccgtactctcttgcctgtaaaaacctcgaaggaccaaagataccctcaaggttctcatctgtgcggtattcttcaaattacaatgacatttcccaaaattatcagatgtgctcaggtatcttctctccaatgagatgagacagatgaacatatttgaccttgaaggtcatggaaagtaggttgagagcaaatgtgtagaacgaaattatgaaaaaaaaagaaattacgcacggcattagctcgatgacttagttataaatagaggcctggtatcggctgtcatgatctcatctctttcctatttacaaaaaaactgcaagtatagacaataaaacaacagcacaaatatcaaaaaaggaattatgagcaacgttactacgccgtggtggaaacaatgggaccctgataccgttacacttaccgctgaaacccctgatgatgtgtggaagacctgtgttttgcaaggtgtttattttggtgaaaacgagtacaatggtaacttaggtgccagaatatcttccgtctttgttattcttttcgtgagtacttttttcactatgttcccattaatctcaacaaaagtgaaaagattgagaattcctttatatgcttaccttttcgcaaaatattttggttccggtgttattgttgcaactgcatttatccacttaatggaccctgcttatggtgcgattggtggtaacacttgtgtaggacaaaccggtaactggggtatctattcgtggtgtcctgccattatgctaacgagtttgaccttcactttccttactgacctgttcagtagcgtctgggttgaaagaaagtatggtctttcccatgaccatacccacgatgacattaaagacactgttgtgaataatgctgcagttgtttcaactgagaatgagaatggtactgcaaatggatctcatgacaccaagaacggaatagagtattatgaagattcagacgctacatccatggatgttgttcaatcatttcaagcacaattttatgcctttttaattttagaattcggtgtgattttccactccgttatgatcggtctaaatctgggaagtactggtgaagagttcgccaccctataccctgtcttagtgttccatcaatcatttgaaggtttaggtattggtgcaagattgtcagccattgaattccctagatcaaagagatggtggccatgggccctatgtgttgcgtatgggttaaccacaccaatctgtgtagccatcggtttgggtgttcgtacacaatacgtcagcggttcttacactgcccttgttgtctctggtgttttggatgccatttctgccggtatcttattgtacactggtttggttgaactactagcaagagactttatattcaatcctcaaagaacaaaggatctaagacaactgtccttcaacgttatatgcactcttttcggtgctggtatcatggctttgatcggtaagtgggcttaaaccaaagcgaaattctgcatgttccatatagattctatttcatattttatagttatttattctttagtaatagcaaaaaaacagtaataatttttctttaacagtctcggacaataaatacgctaaggaagatgaaaatgacaacttttacgctggtgtgcacaagtggtaccagaatacgtggccaccaaaacaatgacagagatagggagaaccaagtctagaaattacaaatgttcttttgacggttgtgagaaagtctacaacagacctagtttgcttcagcaacaccaaaattcgcataccaatcaaaagccatatcattgtgatgagccgggatgtggcaaaaaatttataagaccgtgccatctacgagttcacaaatggactcattcacaaatcaagcccaaagcgtgcacattatgtcaaaaaagatttgtcacaaatcagcaattaagaaggcatttaaatagtcatgaaagaaaaagcaagcttgcatcaagaattgaccgtaaacacgaaggagtgaatgcgaatgtgaaagcagaactcaatggcaaggagggaggttttgacccaaaattacctcccggctctccaatgtgtggtgaagaattctcgcaaggtcacttgcctggatatgatgacatgcaagtgctacaatgcccatacaaatcatgtcaaaaagttaccagcttcaatgacgatctaataaatcatatgttgcaacatcatatagcaagtaagcttgttgtaccatctggagatccatctctgaaggaatcgcttccaacctctgagaaatccagcagcaccgacactacatccatttcacaactttcatttagcactactgggacaagcagtagtgaaagcgttgatagcactacggcacaaaccccaactggtccagagagttactggtcggataaccggtgcaaacatagtgattgtcaagagcttagttcattcgcatctgtatttgatctcattgaccactatgaccacacgcatgccttcattcccgagacgctggtaaagtacagctacattcatttatataagcctagcgtctgggatttattcgaatactgaacgccatagaatagcaatttccgtcctttactcatgtgatccgaactatgaaacaaagaaaaggcaagagtatagcgtgatacctattacgtattacgtatacatcctattattcttgaaaaaaagtgcggggctccagagctccacattggtgaccccagagtatactgctctttctaatgccttttccatcatgttactacgagttttctgaacctcctcgcacattggtacctagaaatggctatcatgccggacggcaccgggaaataaaccggacggcacaaaaaaatcgaagaaaagagatttctttttctcgcgggcagtttttccggtcgatcgacattcgtacggtactttctctgtttcagggacatcatgttgtaaaagaaaaaggcagtttaggtaatcgttcttttctttctgaaaaattttccacgacgacgacgacgacgacgaccacgaaacactttgattgcgagatccacgagattacctcctgctgaggcgagcttgcaaatatcgtgttctattccgtgatgtttctttgttgcaccttcgccactgtcttatctacaaaactataaaaaagagtaatcctaccccatatctaaaaaaaattccttaacttttataacttaacttcaaagtttcttaatattttttcgctttttctttgaaaagattgtaggaatataattctccacacataataagtacgttaattaaataaaatggttcatttaggtccaaaaaaaccacaagccagaaagggttccatggccgatgtgccaaaggaattgatgcaacaaattgagaattttgaaaaaattttcactgttccaactgaaactttacaagccgttaccaagcatttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcaccaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacattgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaaacttaatttgtaaattaagtttgaacaacaagaaggtgccctttttttaattatgtgaacatgttttctatgatcttttttttcttacttttacaactgtgatattgtataaactttgttagaaattcacgggatttattcgtgacgataaatatttatagacaaagaatatgacgatttatgaaatctacatgattttagtttcttttaacaattgctcgtttttttctcttgcttaattttaaatttttttggtagtaaaagatgcttatataaggatttcgtatttattgttcaagtatttaaagactagatgtctttattcttcataaaattgcacgccaattttaaccctctctacacttcctctagatagcttgcgtactttcttttgtagcgtgataattctggaacgaacggaagcacttgttttaagatcgtccttactaattctcacaaccacttcatacccgcgatttttacgcgtggattcttcttttacctttgtagtgtttgcatcatcaatgattaattcttttaaactggtctccacctcactacgcttagaaacatggaaatcaaatacgttatctctgatattaccacctggatgaacaccgcaaatcacatacataatcgtaccaatatacttcgtccaccatacaattctcaatgcttcagctttatcaccttcgcgtagaactacttgttctaattcttgggtgtatttttcttcagattccggaatgttgccgccccatctactacatagagcaattcctatcagcgctctagctctgtgagataatccatgacagccggctattatccctcttgtagcaacatgtaatgcagctgttggttgtaactcctttggataagaggcatgaacaaatgctaggttacataaagcaggagcaatcctttcgtttactatttctggtatatcttcttgtgggattgatgttctcaatagatatagatatttttcagtaagtaatggagcataaggacgggacgcaattagcaatggatcttgtgcacgaatttcttttggaagaagagaataaagtgaaccctctcgaacaccaccctcactaaaatgtacagctttgatctggggaatcgcttcaaaaacagcactcatgaacaaaccaacggcaggaagttgtaaagcccttctatcagaaaccttaaatattttatgctcttttgaagaacctggtattttttgttttaggaatagataatctgacatagacgagaattcttcataagtgcaagcatatccgttaattattgtttggatgggataaccttccgactggtaaagaagcagatgtcccatacctcttaaaccacccccacgggtccaaaggtcaaatccaccttctttcttggcatcatcaatcatttcttgaggtataccaattttttcaatcgcatctttgtacgcttctttaatctcataaaaaagtgccctattatcatctgttctcattcttctcaaaagagttccagctccatatggcaaagatacaggtttgctggattgcttgacttctccgtgcgagcttattacccatgataactgagtactaccgcctgccacatctagatatagacctcttactgtattaaatgaggaaacaacaccatatatgccgaccctagtttcatcttcctggcctaatatttctactttccagccagtgctaccgtaaacagcattaacaaattcatccgcgttaatagcatctcgcgtggcttctgttgcaattactctgacactagtttcaggtacaccaaaatcatcgcaaattaatttgaatctcttcatggcagaacaaacctcttttataatatctctgggaatagggcattttgcgttcgtatgtgtattatattgaacttcgtatagagaaagaccaaccctatctttaaaaacacaaggcataattcttgcatgatgtgcagccttggaagatatactaaaacgaataccattagaacctatgtcgacgattccacacaagtttctcgacacgacctcagtctcggtatcactatcgctaagtgttgacatttgtggcacgcctacacttttcgttcaaaacaatccttagtaaaggacacttccaagagtgagtttcttttttaaaaggtacatatgaatgaattactaatctcacttcgattctttcaattgatctaggaactccgccggcaaagttatcctatctcggcattctgacccggatcgcttatcgcggtcatgtgactaataattgaaatgataaatagcacgatatgtaacaatagtaatatatcaattgacaatgtcatcttgttccctaataaatagtaaaggttccaattgtttcaccactggctgcatttcaaaaacaaagcattataagtaaactctcacacatgctaacttctgttgggaagcagtacaaataacagaaaggattggggtaatgaatatcagtaatgtctattgttcccggccatgccgctcattcaaactctatatcggaacccaagaaatccagatcaccattcggatcacttattgagctcgccgctgtattactagaataactatcggatgattcaagatcaataggaattatttcagggcagttttcggggcctgattttaggacttgttcacccgcttccatagacgacatctgttgcgatagattataaatttttgaaggaagtgtatgaactgtcgcaatatctgtattttcttcttgccactgctttggtttactattcagtcttttttccagatgaggggttgtgttgatattttttgcaagcagtggctggcgtatttgatcaggttttgatactggcttgattgaggagggtcctttttcttttatatactttactggaataccctctttacaacataaatgtctgcattgcgttttgtctttgcagctatgaaaacactcgtaattgccattagatcttacttggcggccattactaaaatgtgaagaagagtgtgcctccgggtgaataactgctgcagattcaaccgcctttgatgatttcttcctttcattcaaataatctagtatactatcatctgaggatagcgattcttctaatccatctttatgggaaaccctagacgttttccccacttctccgtcactactgctttcatagaagaggcatttttctaaactatttagatctttccttatatttggtgtcttcgcagagaactgtgatgccaaatgatcagtggaatatacgattgttttgccgagtccggcgatttcttggcaatgaattgagaattctattttttctagttttggtgatatttttgctgaaattctaaagccccttggtgactgtagtttgttaagttgcaatcttctaaagtcgattaactctcctgagcttttctcggtttcgatatctaatgagaggtgctgaccatgccaaatgctagacttgaatgttgcactaatctcaactttaaatgtcaaccacaactcttcattttctattttgcaattttctagttttgttctaatattcagacaaggcaacaaagaaatgtcgtttttaatttttatgccgtttccaatcttgaggttaagatagtattcaatctgagtatctgacaaatgccccatttcttctagattggtaattccatgtcgtattagccttcttactgaaactagtccaattgttttcaattgcctaagaaccattggcgtgttttcccagcagtgaccattcaggcttcgcagtaagaacaaagtatttttcagtgatgttccatcacttttttcaataaatgtgtctaccatgcattttagtaatctaaaacaatgtctaaaaacgaggaatttatcctgaacaagagtttgatgtagtttagaagcgccttcgtatgatggaaattctaacccacctaactcatattgaatcaaaagagaaaccttttgactaaccctgtcaattatttggctctgtttcttctcggttaaaaatggatatttcaaaagtggcgataaattgatttctttgaacaattttttttcattgtgcctcaccctcataactgaaaactcttcagaagtggccagtaaatttagtatcccttgtaatgatagaaatttttttgcgttaatgaattgtttcatcgactcaaaggatatataatgtcgcgtcattgcatttccgtacgctgtagatttgtactccccattgctgatatcgattattttcacttttactaaggtgtcaagcaaatactgacagaattgatttatctgagagtcttcaacggaatgaaaactaacgtatctgttcacctcttgatatgcagctggattcttcccaaatctaacgtaaaagaatgtgtttcgtagccaatttactgcagtttcaattgaatatacagtttccaaagaggtttctgctgctaaatgctcgatcaaattcaaatgtaatgaactttccaaaacgtcagttccatgaattaagttttcatatgtttgcttcattttagagtctgtcatgattactgcgcacccgtgagtttcaaattgaggtcttcctgcccgcccaatcatttgcagtacatctaggtctgaatactcttggatttcagaagagttccaacttttggtgcctttgataatgaccaaatatgcgggaaggttcacaccaacagctaacgttgaagttgaacacaatatattaattgaacctgcaagaaattctttctcaacggcagtacggtcttctaaagaaattccagcatgatggaaagcgataccttgttgcatacattcatttaatattttatcggagggattatgattacatcttttcttactttttgaaaaaatatgattatttaataaaaattttgctgttgatatagttgaagccctagtcggacaaaatattagtacgggacgattatcggcatgcttttcaattatttcaatcaatttggaattatatatagcatctttttggaagtcatttttgcaattgaaggagtacccataaacaaacttcgttaactgaacttgcctgtacgattcgtcaaaagaaagaatatttgcaggaagctcgttgttagttttgagccacaatgctaggtcttctatatttggaactgttgcacttaaagcaacaaaccgaatgttttgacacattgtattcatccttgtcagaattacttccaaagatgctcctcttttctcctttatggtatgaatctcatcaactaggacaagtttgaccaattcgaataatcggctgtaatcggaccatcttcttgttaacaaatcccatttttctggtgtcgtaattattatgttacattttttagccttttcagtttccagaaaagaggtatcactagtaagcataccaacagaaagattcacaaaggaaggaaaccagttcttgtacatctcgtaacatagagatttggttggcgcgatgtatataattttggtgttattggtatcactatttgtttcctttataagacgtaatattgccaattcaaataatacagtcttgcctgatccggttggtgaagaaattatgcagttctcgttactctcataaatactaggaaaagcctctgattgcattttattaaattctgtaaatttaaaaacccctctgaatgaatctggtaatatggtcgtgctcaaacatttcttcgctgatttccttatcgtgaccttcttaggtttcttcgcctcttcatcaggtgtctgctctaaatcgtgatcaaataatttactagttacttgtgtatcatctgctgttattgaaaaattatcgtctttgtcgaagaattgcagaccacggccctcaaatatttcctctgtttcattttcatcatcacaatcatccagtaaactgttataagacaaacctactttaaaacttggttggcggctatttttcttatttcttttaaatgtagcagactggtcgttaaagtcaatatctataagtcctctgaaattctagtccagaaaaaccacttttggttgcatttccgctagataataaaagaaagaggtaacaatgttagtcaaaatactgttgttgtccgatatggtgtaaactgataagggtgttgctaagcttcgttactactatttggagagggtctacttctttttcctgtaccgaggcgatcaaactttgttttcatccttacgacgcctcttaagttgtcaaatccaccttgaggtatcaatcattttcaatgaaaggatttcttgatagatgatactaatagtcccgttttgtttataatccggggcaaagtctaaatacccgccgagcctgcatccattcgtggtacatgatatgttaaaactacaacaaggcataaaaaagggaagtatatatgattaattatatatacgtaaaggaaaagatacgtagttaaagattgtttttgttggtatcaatggaatcaaagatgagtgaagaagaagcgcataaaacagtggaggtggatgacgtcggggttcaattggatgagggcgatgaagaagaccttttggagtatgatgatgaactcgtggaggaacaaccatcggacgcccgtatacgcaacgtggcagagactttaatgaaaagcgaattgcccaaagtcaccgtggaatataaagatactacatttctgttgttcacgtcggatgataagaacgaaagtaacaaccccataatatgtgaaaacgctgctctttatcagcgacccatgggggaattcatggaatccattcgtaaatttatgggaaatcgttttggcaggttggcttttgctacgaaggagttggttttacaactgaaaagcctcgatttgaccttgttcgaagataatgtctacaacaaccatatttcattcagcgatgtttatactatatttaaaatcctgaaggaaagatcggagtctaattttgaaactgatataccgacgcacttggctattgaattaagtacaaggccaagatttgtctctcggtacaacgccttggttgaattaactgaaagctcagctacgttgaaaaacataaagccattttctaacgatgaaacgcatcccttaattgtggatgacaatgaccaatatgcacaccagaatacttcagaagtcattgtaatggacatagatgatgacgtaggtgaggattctgaagactaaagtagccatgtttaatcagcactgatcgtgggaaatcctgatgtccaacggtgagtttctgatttcccagtcacggattccttttgagaatcttctcccgcgaataaattattggctctgtgtaatatttaaggtcgccttctttttcgtttgtatagtcagcagttaagtattcattaattttggatgatgcaaaggtccatattcgatttttgatagcccttcccccttttttgtagcgaattgtattattgttttgtattgttttttcgtcattttcttcaattttttacaagttttactttcggaagaattgctgaaagtattttctgttaggatatgtaaaatacaagcataaaatatgtttcaggagaagaaaatcactcaatagtgccacaccattgttaacgagctcgagtaattgaatcaatttagagaaatagatcatattacaaaaatactatgattattgaacgttgggaagtaaagttatctaaatgtaaccaaaatgtgggcggctattctgttctgtcaggaaacttaaaagaaaacatcaaactgggaagacgagcacaaaaatatttgaaagagctaagaaatttgcaacttaaaccactgaaaatcggagggtatgaaaattgcggcacgatcaatggtgaagagtattttttggaggtaattcacatcacctctggaagacaaaaaatagatgtagccgttggcaaaacatggaatgtgactaacattgagaatgacaacaaagaagaactacagtatgagttattcaaggaaaagttaaaagtcgagaaacaggacatgttattttttagctggatgaaaagtctttcagttcaattaaatgctcctcttcaccaaaaaatgacggaacacggtttggcagacgataacacgaggttagagtggttcaacatcccacttctcagaagaagtcaatacaggaaaaaggtaccatatccgagtttaagacaaatgtcctctgtactggaagtgcaatgcagcacactaacggaggaaaagttgaacttctgcgttggattttctgataaacctttgtcagaatggaagccccaaatttttgagcaaacctacaatagataccgtttacaacggatctcacctgagaaatctttcaaatataagagtaggtgcagtaagtacaatttcaagaccagttcgcaaagctgggttgtgaaagtcccagaacatgatcaacagcttaatacgtttgaaaaacgttatgatgaactctttgatgctcaatttaataaactagaattttttaaaataagaatgaaaaaattgaaaaagaataagccaattgagaaaaagaactataaaatatggtgtctagaaaaagaagacctaaaggatttggtatgggatcctctgaaaagaatttgcaatcattctaggtatgcaatatttgagcatgttaccataaatagggaggcctattcgatcaaaccattaaggttaacttttcaaaaattagattccggctcccttgacctgatcgataatcaaaaaaagacgtttggtagtataaagcttgcaatgagtatgccagatgtaaaaaaaactgaaaatcagtcaattgaagaaagtgaaagacacgatgaaactgctattgaaaccgaagaatttgatgaaaatgattgtctttcatctaaggcggatattaacacatcattagctcctcaaaagagatctttcatcgataatgaactaatgtccatgttagtcaccaaaaaaaaaataaagaaggacaaggatgttagtgacaccggtatatcttccacttcatacttgataaattctgggacatatgcaaattctcatattgaaattcctacctctaattcagtttacaatggaaaggaagattgctcatttaataactactcagtaaagcattcaatattggaagaagatattgagaataaatgcatagccgtaaatgaaaacaaggtgattgagaaccaaaaggtaattcagtcattatgtaaaaattcccatctagaccttatcgaacaatcttactttggagaatgcgatttcattataaaccattcaacatgtgtatataaaattcaggcgagccgatttatgcaactcagaaataacggctcattgcattacgataaagcggtaaacgatcttttaactgaatttcagagagtcattataattgtggagttttctgaaataatacaagacgttgatcctgatcttttctggaaaatcaaactttatttattgaattcacgtgttgatgtttttttcattcatgagactactgacttttttattgattggatgaaatatttcattgcaaaatgggccttttcatataacgatgagaaagaaaaaaatattgcaaatgccgatattcttctagatttgggatttaacatcctcttagtacggaaaattttccagacatatagtctcgaagaattttttatggcaataataaaggaagaaagcaaagctgttaaaatgcttacggtttcacaaatgactcgcctgaagaagttattaaccttagaatggtaaatccagcaaggatcgttacccggtaaactatttatactacgcctgcctctttcgttcttcgactacatgctacagttagtaaattcaaccaaggaaaatgtatttattaacatgaactagccacctaattaacccttaccttattttttatacccttggatcatcggagtatctgtagatcatatgttaacgtatgtataatattacatctgtcacaataaacaacccgaaaaaaataccgcacggaaaatgagttactgattaagatgcactttttggtgagggtgcgtgacttgaaactaaaaattaccaatagtcaaaccctttccactttcgagggaagcaatatctgaaatttatatttttagaaatttccaagagaaagtggcttttaacgaggttcttcttcttcatccccttttttaccaatattcctttttatggttgtattcgaaataactatacttggggccaatggaggacccaccgaatacggaacacagtgttttatacttaagcctgctagaacagaggatccagaattaatagctgtagacggtggtgcaggaatgtaccagctacgggagatgttggtccaagggcgaaatgaaaatgaaggtgatgatgagcttgttccaagcttttatgaacatgatcgagagccaatagagttttttattgattccaaactgaacatacaaaagggattatccaagtccttgctacaatcattaaagaggcagggagagcattttgaaagcgccaatacaatgaagaaaacttacgaggttttccaaggaattaccgactactacattacccatccccatctggaccatattagtgggctggtagtaaactccccctcaatatatgagcaggaaaacagtaaaaagaaaactatttggggattaccgcatactattgacgttttgcaaaagcatgtctttaatgacttaatatggccagatttaacggcagaacgttcaagaaaattgaagctaaaatgcttgaatccgaaggaagttcaaaagtgcactatctttccttgggatgtaataccgttcaaagttcatcatgggataggcgtcaagactggcgcgccggtatacagcaccttctatatcttcagagacaggaaaagcaaagactgtataatagtttgcggagatgttgagcaggaccgcagagaatctgaagaatctctacttgaagaattttggtcttacgttgctgaaaatataccgcttgtgcatctcaagggtatattagtcgaatgttcatgcccattatcttccaagcccgagcaattgtatggtcatctatctccaatatatttaatcaacgaattatccaatttgaacactttatacaacagtagtaagggattaagcggtttgaatgttatcgttactcacgttaagtcaacacctgctaaaagagacccaagactaaccatactcgaagagttacgatttttagctgaggagaggaacttaggagacttgagaatatctattgcgctagaaggccacactttgtttctataatgtacacaacgtcaataacataatactacgtagatgaaaagcggaaaaattcattacccgggagcaagcaaaatactagtagtaactaatgaaacttctttccattattattgatgagttaacttatgtagactcatctttgaatcccctatcccaacataagtcccggaatggaactccgtagtttttctagacagcctgatggcatacttgctaacccaagattgggaagggaggaagtattggaaggtgaacatccgcaagatgctagattagcccgacaaagcatttggttgagcccaagtttaattgcggagtatatacagctttttttcaattttattataggaactataggactgtctcttgctattaaattcattttgatgataagaaacgatgttaacttaaaactggagcataacgtgagggaagaattagataaaattgcaacttgcaaatcaaggtattttgaaaaccagtgcgaacctcatatgagggttccagcattggaggtacgttgcaatgaatggtcaaaatgtatgaacaaggaaatagtgtctggctccgattaccaatgggctaaagcatgggctcgtactctggcggaggtaataaatgctttttttgaagcgttcagtatacgatctttccttttcattttaattagcataataggtataatatttgttaccaatacgagtttcggatcatacagggtttatctcaataataaagatacaaaatcggttcgccatgcatagtgtatataacttaatctaatctgcacatttatattatttagatccatacgtcgatgaggatatgcgcaggaaagacataaaggaatattgttatttcaaagattttctccactccttaaacccgttcgataatatatgttctccatcaatcaaacctgaatattcctcatcactttcttcaatttcggataatcttaggtgattattttcgaaaaccaacttaaatgctcttatttgagaatgaggatcctcatctcttggtatcattttcaaaagccactcagtaaggagaccataccatttaatggcttctaaacatgcacttccaacttgtggattattgttctttaataaaacaggtacttcctccgttgaaaactcttccacagtttttaatacataatggtcgtctttaaaaccatatatgatccttgggatcccaactaagaagcattgcagccaggtccggaacagtttacgctcaaacttatgcgtatccgatatgttcgcaacttgctgcgtacatttcaattcggcataatgttttaaattgtctctaccgttttctttaaagtcaaatatacaatccacctcagcaccaagaattaacttgcagttacctacaccagttctcacaacactaatgtattcatctccatgcgatacaatccttttagttcttttttctatcacttcacggggtgtatactgcaacggattggaaagagtagccaaagtttcaaacttgtaccctgtaaatacattcagatcttgatttatattacgccctgcttcagttgcagaggaagccttagctgcattgacagcttcaggcacttccttgataaaaagttggccgttgaatgaaacgatacgaagatcaactgtattaaaagatggagagtcaaatgcacatgaaattaatttccgtgctattcctctaaaagtaattatatcagcattaattttttttcctttatgtctttcagagctttctatggtttctaatagcccacgcagggaacacctgtcttcaaaatctttgtaataatccttaaatttctgaaatcctgatgaaagatccaacttcctgtccaattcagcgtctggaagatagtagtaattcaaattcgtatcatcgctaattaaatattcttcatccttagttcttgaatagaatcctatttcctttggctgcttcagagctgttgtcgaccctctttgctttacgaacaaatttgcactaacacccattgggatacactatgttggtctaatatttcgctattctttcaccatattacagaagtattagtaacattaccagacctcatctgttcctaatattctcgaagtaaatttttcaatttacccgaatgcttactctttttttcttcttcgttaaaagcaagataaagtgaaaaaaatggaagataacttccataagaatgacgaaactattttcaaaggttaaggaaagcatagaagggatcaagatgccatctaccttgactattaatggaaaagccccaattgtggcttatgctgaactaattgctgctcgtattgtgaatgcgttagctcctaactccatagctattaagttggtggacgataagaaagcacctgctgccaagctcgatgatgctactgaagatgtcttcaacaagataactagcaaattcgccgccatcttcgataatggtgataaagagcaagttgctaaatgggttaatctggcccaaaaggaattagttatcaagaactttgctaaattatcacaatcattggaaacactagattctcaattgaacctaagaacctttattcttggcggcttgaagtattctgccgctgatgtagcatgttggggtgctttaagatccaatggtatgtgcggttccatcatcaagaacaaggttgatgttaacgtttctcgttggtacactttgttagaaatggatcccatcttcggcgaagctcacgatttcttgagcaaatctttactagaattaaagaaaagtgctaatgtgggtaagaagaaggaaactcacaaggctaactttgaaattgatttgccagatgccaaaatgggtgaagtcgtcactcgtttcccacctgaaccttctggatacttacatattggacatgccaaagctgccttgttgaaccaatattttgctcaagcttacaagggtaagttgattattagattcgatgacaccaacccatcgaaggaaaaggaagaattccaagactctattttggaagatttggatttattaggaatcaagggtgatagaataacctactcatctgactacttccaagaaatgtacgactactgtgttcaaatgatcaaggatggtaaagcttactgtgacgacactccaactgaaaagatgagagaagaacgtatggatggtgttgcttctgccagaagagatcgttctgttgaagagaacttaagaatttttaccgaagaaatgaaaaacggtactgaagaaggtttgaagaactgtgttcgtgccaagatcgattacaaggctttgaacaagactctaagagatcctgtcatttacagatgtaatctaacccctcaccacagaaccggatcaacttggaagatctacccaacttatgatttctgtgtcccaattgttgatgctattgaaggtgttacccacgctttacgtaccattgaatatagagaccgtaacgctcaatatgattggatgttacaagctttgcgtttgagaaaagtccatatttgggatttcgctcgtatcaatttcgttagaaccttgttgtctaagagaaagttacaatggatggttgacaaggacttggtcggaaattgggacgatccaaggttcccaactgtcaggggtgtgagaagaagaggtatgactgtcgaaggtttgaggaacttcgtcttatcccaaggtccatccagaaatgtcattaacttggaatggaacttgatctgggctttcaacaagaaggtcattgatccaattgctccaagacacactgctatcgtcaacccagttaaaatccacttggaaggctccgaagctccacaagaaccaaagattgaaatgaaaccaaaacacaagaaaaacccagctgtgggcgaaaagaaagtcatttactacaaagacattgttgtcgacaaagatgatgctgacgtcatcaatgttgatgaagaagtcactttaatggactggggtaatgtcattattactaaaaagaatgacgatggttctatggttgccaaattgaatttggaaggtgatttcaaaaagaccaagcacaagttgacttggttagctgatactaaagatgtcgtccctgttgatttagttgacttcgaccatttgattaccaaggacagattggaagaagacgaaagtttcgaagatttcttgactcctcaaacagaattccacacggatgccattgctgacttgaatgttaaggatatgaagattggtgatatcatccaattcgaaagaaagggctactacagattggatgctttacccaaggatggtaagccatatgtcttttttaccatcccagatggtaaatctgtcaacaagtatggtgcaaagaaataagcatcacataagtaatgtatatacatatttatgttatttctcaaccagtaccttttgaacaatatcttttataagtgaatggtttgctttctgaaccagtcctgtgttcgctgccttgaatcatgtaaggatagcagcttatgacatgtatgtctacctatagaactttgactgtaaaagtttatcatccattacccggttttgtaattttgacaatttatattttattgaaattggttcaaatagtgactacgagctggaaggaaaatattcaaagttacaaaaggtacttgaaggataccaaagtttgtaattgtattgcactaatttgttgagagcactatagaaatgtctgatttagatgaggatttattagccttggctggtgccgatgaatccgaagaagaagatcaagttttgacaactacatctgccaaaagggcaaaaaacaacgaccaatctctttccaagaaaaggagaattgaagtcggcagtgtagaggatgatgatgaggaggacgattataacccttactctgtaggaaatgcagactacggttccgaagaagaagaagaagctaatccttttcccttggaaggaaagtacaaggatgagagcgacagagagcacctggaatccttacctgaaatggaacgtgagactctattatttgaaagatctcaaatcatgcagaagtaccaggagaggaaactttttagagcacgtggaagagatatgaaggaacaacaacagagagccaagaacgacgaagattccagaaagaccagagcttccactagatcaacccatgctactgggcattctgatatcaaggcttcaaaactttcgcaattaaagaaacaaagagcgaggaaaaaccgtcactacagcgataatgaagacgaagacgatgaggaagattacagggaagaagactacaaggacgatgaagggagtgaatacggggatgatgaagaatacaatccttttgatagaagggatacatacgacaaaagagaagaagtggagtgggctgaagaggaggacgagcaagacagagagcctcagatttctgatttcaacaaactaaggatcggtcgttcatttgtcgcaaaattttgtttttatcccgggtttgaagatgcagtcaaaggttgttatgggagagtcaatgttggcacagataaacgtaccggcaaaacttcttaccgtatggtgagaattgagagagttttcttgcaaaaaccttacaatatgggtaagttctatactaaccagtatttcggtgttacccaaggtaaagacagaaaggtttttcaaatgaattattttagtgatggtttgtttgccgaagacgaataccaaaggtatctcagggcattggataattcgcaaatgattaaaccttctttacattctttgagtaacaaaacgaaagaggttatggattttgtcaatacaccattgactgataaaactacagatgaggttgttcgccataggatgcaattcaataaaaaactatctggtacgaatgcagtcttggagaaaactgtattgagagaaaaattgcaatatgccaaggagactaataatgaaaaggacattgcaaaatactctgctcagttaagaaactttgagaaacgaatgtctgtatacgagaagcatcatgaaaatgaccaatctgacattaaaaaactaggcgagttgacctctaagaatagaaaattgaatatgagtaacatcagaaatgcagagcatgtgaaaaaagaagacagtaataactttgattcaaagagcgatcctttcagcaggctaaaaaccaggaccaaagtttactatcaggagatacaaaaggaagaaaacgcaaaagctaaagaaattgcacaacaagagaagctacaagaagataaagatgctaaagataagcgtgagaaagagctacttgtggcacaattcaggcgccttggtgggttggagcgcatggttggtgaattggatatcaaatttgaccttaagttttagtaggcaggacaatttcagtgtttgtaaaattatatttatatttatatatttaaatatactaaataaaaataatactatcatcgttgtgatgacaaaaaaaaaaaatgaacagaaaataatagtgatgtgaagggtttcgtgccaaggaacaaggccatgcatagtaaaccttctcactatgccaagtgaggataaattgggtgaagagatatcaacgagggtggttaatgagtattcaaaactaaaatctgcctgcagaccaataattaggccttcaggtatcagagagtggacaatattggcaggtgttgcagctattaacagagatggcggtgcgaataagatagagatactttccatagctactggtgtgaaggctttgccagattcagaactacaaagaagtgaggggaagattctgcatgactgtcatgcagaaatactggcattacgaggtgctaatacagttttattaaaccgtattcaaaactataatccatcaagtggtgataaattcattcaacataatgacgagatacctgccagattcaatttaaaggaaaactgggagttggcattgtacatctcgagattgccctgtggtgatgccagcatgacttttctgaatgataattgcaaaaatgatgatttcatcaaaatagaagatagcgacgaatttcaatacgtcgaccgtagtgtgaaaacaatattgaggggacgcttgaatttcaatagaagaaatgtcgttaggactaaaccaggaagatatgattccaatatcactttatctaaatcctgttctgataaattattaatgaaacaacggtcgtcggtactgaattgtttaaattatgaactctttgaaaaacctgtatttttaaagtacattgtgattcctaatttagaagatgaaacgaaacattatctagagcaatcatttcacactcgtctaccgaatctagataatgaaattaaattcctgaattgcctcaaaccattttatgatgataaattggatgaggaggatgttcctggtctaatgtgtagtgtcaagctctttatggatgactttagcaccgaagaagcgattcttaatggcgtgaggaatggattttataccaaatcatcgaacccactgaggaaacactgtcaatcgcaagtaagccggtttgcacaatgggaactattcaaaaaaataagaccagagtatgaaggaataagctatttggaatttaaatctcgtcaaaaaaagagaagccagttaattatcgcaataaagaacattttatctcccgatggttggatacccaccagaacggatgatgtgaagtaatatatatatatatattgttgaatatgcgtatatgcacacttttttgttagtgcaccttaaagaaatatatacacagtagaaatatctatatatccagagttcatctatctttccctctctgtggtattatcatcacatattttatcattttttatcatcttcttcgtcatcgtcagatggaccatcatctatcatttccccatcctcattgttatcacctgatccattggtactatcaatcgctaactcggcaccctgcaaaaggtcaattaattcatccagttcatcgccatgaaccaaatcaactggcttttgattgttatagtttctcaccctaggatccgcacccacttcaattaagtttctagcaataaaagttccatgctcaggttcctcttgactgtatctgacagtaacatgtaacggagtgtcgccatcaacgtcgttttgtgggtctatttcgatttcaccgtcttgatcgagaatcttgtcgagaacttcccaggatccatacttacaacataaatgtaacgctgtattccccagtggttctttggattcgttaattagctttgcaatcttctcaggatcattatctaagctatcaaatacggtctccaaaagatccagattgtttcttctagctgcatccagcaattgttcacttaaagaagcaccttcagtattcatgatcaaaaaaagaaactaatttattttgtgaaaaacttcgacttctttcacttatgacttttttcactgggattcagaaactacctcacaggacccctatataatgaatttattgtcaacctttctatcaacgcgttataccttgggtatactaaggaaaaaaaaaagaatatatatggatgtatatgacctgcatacacaatccgaaaatcttgaacgtaattgtaacactatcaacacattaaaatggatattaatgaattgataataggtgctcaatcagctgataaacacactagagaagttgcggaaacgcaattgttacagtggtgtgattcagatgcatctcaagtgtttaaagcgctggcaaacgttgccttacagcacgaagcttttctagaatcgagacagtttgctttattgtcgttaagaaaattgattaccatgtattggagtccaggatttgaatcttaccgttctacatcgaacgtcgaagtagatgttaaagattttatccgagaagtactactgaaattatgcttaaatgacaatgaaaataccaaaataaaaaatggtgcatcttactgtattgttcagatatctgcggttgattttcctgatcaatggccgcagcttttaacagttatttatgatgctatctctcatcagcattcattaaatgcgatgtctttattgaatgaaatttacgatgatgtcgtatctgaagaaatgttctttgaaggcggaattggcttggcgacaatggagatcgttttcaaagtactcaatacagaaacttctactttgatagccaaaattgctgctttgaagctacttaaagcatgtcttctgcaaatgagctcccataatgagtatgatgaggcgtcacgaaaaagttttgtctcccaatgtttagctacttctttacagatattgggacaattgttgactttgaattttggaaacgtagatgttatttctcagttgaaatttaaatctattatatacgagaatttggtttttattaaaaatgatttctctagaaagcatttctcaagtgaattacaaaaacagttcaaaataatggcaatccaagatctggaaaacgttacccatataaatgcaaatgtcgaaactactgaaagtgaaccccttttagaaacagttcatgattgttctatttatattgtagaatttttgactagtgtttgcactttgcaatttagtgttgaagagatgaacaaaattataacatctttaaccattctttgtcagctaagttctgagacaagagagatatggacaagcgatttcaatacatttgtgtcgaaggaaacaggcctagcggcatcatataatgttagagatcaagccaatgaattttttacttcattacccaatcctcaactttccctaattttcaaagttgtttccagcgatatagaacacagcacgtgtaattattcaactttagaatctttactatatctcttacagtgtattttgcttaatgatgatgagataactggtgaaaatatcgatcaatctttgcaaattttaataaaaacgttagaaaatatcttagtatcacaagaaataccagaattaatattggcgcgtgcaattttgactattcccagagtactagacaaatttatagatgcattacctgatatcaaacccttgacatccgcattcttggcaaaaagtcttaatttggcgctaaaatctgataaagagctcattaaatccgcaacattaatagcatttacgtactattgttattttgccgaactagattcagtccttggaccagaggtctgctcaaaaacccaggaaaaagtaattcgaataatcaaccaggttagtagtgatgccgaagaggacactaatggggctttaatggaagtattaagtcaagtcattagctacaatccgaaagaacctcattcaagaaaggaaattttacaggctgaatttcatcttgtgttcactatctcatccgaggatccagcaaatgtacaggtcgttgtacaaagtcaagaatgcttggagaaactattggataatatcaatatggataattacaaaaattacattgaattatgtctcccatcatttattaatgtgctagattccaacaatgcaaacaattatagatactcacccctgctatcattagtcttggaattcatcacagtttttttgaagaaaaaacccaacgatggatttttaccagatgaaataaatcaatacctatttgaaccattagcaaaagtattagcgttctctactgaagatgagaccctacagttagccacggaggcattcagctacctgattttcaacacagatacacgagccatcgagccaaggttaatggatatcatgaaggttctagaaaggctgctgtctttggaggtatcggattcagccgctatgaacgtcggtccattggtagttgccatattcacaaggttttcaaaggaaatccaaccgttaataggaagaattttggaagccgttgtggtaaggttaattaagacacaaaacatttctactgagcaaaaccttctttctgtattatgcttcttaacgtgtaatgatcctaaacaaacggtggattttttgtctagtttccaaattgacaatactgatgctttgacattggtgatgcgaaaatggatagaagcctttgaagtcattagaggtgaaaaaagaatcaaagaaaatatcgttgctttgagcaaccttttcttcctgaacgacgaaaggctacagaaagtggttgtcaatggtgacttgataccatacgaaggggacctgatcattacaagatcaatggctaagaaaatgccagacaggtatgtacaagttccactttataccaagatcattaaattgtttgtttctgagttaagcttccaaagtaaacaaccgaatccagaacaattgatcacaagcgatattaagcaagaagtggtaaatgctaataaagatgacgacaatgatgattgggaagatgtagatgatgtactcgattacgataagttgaaagaatatattgatgatgatgtcgatgaagaagcagacgacgattcagacgatataacgggactcatggacgtgaaggaatctgttgttcagctactggtaagattctttaaagaggttgcaagcaaagatgtgagtggcttccattgtatttacgagactctatccgacagtgaacgtaaagttctttcagaagcccttttgtagcttatatacataagccgtggagatatcagatgtaaagtagttagagtagaaaaaatgcggcaaaataagcgccgtctatataaaagaaagaaagtgttaaataaactgaccacagaaggtggcaaaaataatacgagatttagaagtcagataatggacccgattggaataaacaaagtcttggaccatttagcaccctcagagcttatcaaacctgttaagagttgccataataaaccttcagtgttggtgttggatgacaggattgtggatgcggcaaccaaagatctctacgtgaatgggttccaagaagagattcagtatcagaatcctacaccggagaacttgcaacatatgttccaccaaggtattgaaatattggattcggcaaggatgatcaacgtgacacatttagcgctttggaagccttcttcttttaagttggggaatcctgtggactttgctctagatgataactacgatacgttttggcagagcgatggagggcaaccacaccaattggacattatgtttagtaagagaatggacatctgtgtcatggcaatattcttttcgatgattgcggacgagtcctatgctccaagcttagtgaaagtttacgcggggcatagtccttctgatgcgaggttttataagatgcttgaagtgagaaatgtgaatggctgggtggcactaaggtttctagataatagggaggacgaccagctgctgaaatgtcaattcatcaggcttttgtttccagtcaaccatgaaaacggaaaagatacacatctgagaggcataaggctatatgttccatctaatgagccacatcaagatacccatgagtgggcacagaccctcccagaaactaacaatgtcttccaggatgctatattacgttaataatatgccgtttatgatattttcttccttgctattaccctgccttttgcttttttttttcacttcaattgcagggattatggaataaaaaaaaagttgaaagtagtataaacacaagatcaaaaagtggcaaagaggacccgctctgtttattgctactcaattgtagaagagaaaatagtaggatgtccgatttggaaaccgtagctaaatttctggccgaatcagttattgcttctaccgctaaaacttcggaaagaaatttgaggcagttggagacgcaagatggattcggtttaactttattgcacgttattgcttccacaaacctgccgttatccaccagattagcaggtgctttgttcttcaaaaatttcatcaagcgcaagtgggtagatgaaaatggtaatcatttgctgccggctaacaacgtagaactgatcaaaaaggaaatcgttcctttaatgatcagtctaccaaataatttgcaggtccaaataggagaggcaatttccagtattgctgactctgattttcctgataggtggcctacacttttgagtgatttagcttccagattgagtaatgatgatatggtgacgaataaaggtgtccttacagtggcacattctatttttaaaagatggagacctttatttagatcagatgaactttttttggagattaaattggttcttgacgtgtttactgctccatttttgaacttattgaaaacggtcgatgaacagataacagcgaatgaaaataacaaggcatcgctaaatattttatttgatgtattgctagtattaattaaactatactacgattttaattgtcaagatataccagagttttttgaggataacattcaagtgggtatgggtatcttccataagtatttgtcatattctaatcctttattggaagaccctgacgaaactgaacatgcgtctgtcctaataaaagtaaagtcctctatccaggagctggttcaattgtacacaacaagatatgaagatgtctttggacctatgatcaatgaattcatacaaataacttggaatcttctgacctcaatttcaaaccaacctaaatacgacatcttagtatccaagtccttgtcatttttgactgcagtaacacgtattccaaaatactttgaaatattcaacaacgaatctgccatgaataatatcacagaacaaatcattctgccaaatgttacactacgtgaggaagatgttgaactttttgaagacgatccaattgaatatatccgtagagatctggaaggttcagataccgacactagaagaagggcatgtactgatttcttgaaggaattgaaggaaaaaaatgaagtgttagtcacaaatatttttttggcgcatatgaaagggttcgttgaccagtacatgagtgatccatccaaaaattggaaatttaaagatctttatatttatctattcactgcattggccattaatgggaatattaccaatgccggtgtttcatccacaaacaacttactaaatgttgtagattttttcaccaaggaaattgccccggaccttacttccaacaatattcctcatattattttgagagtggatgccataaaatatatctacactttcagaaatcagttgaccaaagctcagttgattgaactaatgcccattttggccaccttcttacaaacagatgaatatgttgtctacacgtatgctgccattactattgaaaaaattttgactattagagaatcaaatacgtctcctgcttttatttttcataaggaagatatttcgaatagtacagaaattcttttgaaaaatcttattgcattaatcttgaagcatggcagctcccctgaaaagctagctgaaaacgaatttttaatgagatcaatctttagagttttgcagacgtcagaagattccattcaacctttatttcctcagttgttggcacaatttattgaaattgtaacgataatggcaaagaacccatcaaatccaagatttacccattacacttttgaatctattggtgccatcttgaattacactcaaagacaaaacttaccactacttgtagattctatgatgccaacatttttaacggttttctccgaggatattcaagaattcattccatacgtgttccaaatcatcgcatttgttgttgagcagtctgcaacaattccagaaagtatcaagccgttggcacaacctttattagcaccaaatgtatgggaattgaaaggtaatattcctgccgtgacaaggctactaaagagttttataaagacagattcatcgatcttccccgatctagtccctgttttaggtatttttcaaagattgattgcatcaaaggcttatgaagttcatgggtttgacttattagagtacatcatgcttctaatcgacatgaaccgcttgagaccatatattaaacaaatcgcagttttattattacaaagattacagaactctaaaacagaaaggtatgttaaaaaattaacggtattttttggtttgatatctaataaattaggctctgattttttgatccactttattgacgaagtgcaagatgggctttttcaacaaatatggggtaactttattattaccacattacctactattggtaacctgctagatcgtaaaattgcattaattggtgttttgaacatggttataaacggccaatttttccaaagcaaatatccaactttgatttcaagcacaatgaattccattatagagacagcatcatcacaaagtattgcaaacttgaaaaacgattatgttgatttagataacctggaggaaatctccacgtttggttctcatttcagtaagttggttagtattagcgaaaaaccattcgatcctttgcctgaaatcgatgtcaataatggtgtgagattatatgttgctgaagcactaaacaaatataatgctatctctgggaatacatttttaaataccattttgcctcaattgacccaagaaaatcaagtaaaattaaatcaattattagttggtaattaacatggtgtagagaattatatatagatgaaaatggagctcttttgaatagctgtttatatgtagatagagtaagcaaaaatgaaaaaagaaaagcacgtaaatacgatcgcaatatggtttcttttccagcggagtacataggtctgttagaaataaaacgaaacgaaacggaattggtaaaagtacatatacatattgattcagattaaataggccatatggataccatgtggtataagagggcacttttagttctttttaggaatgatattaacattggaatattacaaaattatgtttttttgtctgctgcagctgcggtggaagtagcatgcggctgttcttgtattattttagtagtgatttttttatcctcatgactatcgtcaggatcatcgctagccccacttttcttcgatttcatgactttgatctcagcggctgtcaagaacctcccaccttcaccacgaggtcttcgcatcgcatgtttatgtcgagattcgtgtaagtatggctttcgttctcttgatattcgtagcttttcctctagtttagctcttgcatatcgccttttcaaaattcggtagtactgcttggcattaacataaaacggttgctctgctatagcggttcctaaaacatcgctttgcaagtttggttgattttgggtgtactgggcttgaaccaccaattgctgctgctgctgctgctgctgctgctgctgttgttgttgttgttgttgctgttgttgttgatgaggaggaggcagtaaagtagtcactgcagagaaactagtaaagtcggcagatggttccatcgtactgacactggaagatgtatactgtgactgttgttgtggttccaaggagtccataactctattctgtgatgcccgcaacctgttaaacaaaaacaaatcttcttcatttgtaactcgttgatcttcgcctcttggagaaggcgcttttcccatatccaagggcatctctatgggcttctcctgaagagagggactgcgtgaagctgctgccgttgatgttgcagccgctgtatcagattgcagatctgtttctaatggatgaaatttcgcatccgtttcgtctgctgacatgacgttcttgttcctcttccaaaaagaaatgcttttccaaatacagatgcgattagtaaatcaaattataaacgacagtgagttacctttttgcaagtaccttcaacacaaacactttatttattcatcgaggtccccttgtaaggaagaattaatgttacgatacaagaagttttccgggtaagattgctaaataacgaatttgatggttacatacaatgaattatttacatatacaagctaacgattaaaggatatttacatgactggttggcttggcttccgtgccacacggtagagttcaaatagggctgctgcagtgataccttgaatccgtcttgcttggcctatggtcaatggctgtacgcggttcaagagtagtttgcattcagtggaaagcgtgggtaactgacggtaatcgtaatcttgcggcaacagcatattttcgtctgcttgaaatgccttcacaaactggttctgtttgacaatgtaaggttcgtatttaccttgaatgttaattttggtgataacatgcattgggatgtccagcaaattaatgggtaaatcgggaatgcactcgtagagtttatgtaaatccatctctttgaatctgaatatttcccaagcagatctgttttcagcctgtggcgcgatattagcctgtagtaggctagaccatttttgagagcttagcttgaaattttgaagcgcccgtatggtttcatcatataggtgcttgtctcttgaatatcgacttaaacggacaggagatataattcctagttgagcaccaatgggcgtcagtctgaagtctgcgttatcggctcttacgctgattctgaattctgatctggaagtaaacattctatatggttctatgacgccattattgattagatcgtcaatgagcacaccaatgtacgcttgggaccttttcaaaaccaattgctcccgttcttggcgcgatagtaatcctgcattgatacctgcaatgatcccctgtgcagcggcttcctcgtagcctgtagtaccatttatttgtccagccaagaatagtccatccaccaattttgtttccaagctaggctttaattgccgtgggtctacgtagtcgtattccacgccgtatgccggctgcaagatctcaacatttgccatgcccgggatgagcctcatcatttgtaactggacatcctcaggcatagaattggatatcccgttcggataaatgacgtcggagttgaaaccttctggttccaaccatatcttatgggaagatctatcagggaaccttagaatcttagcttcgatggagggacaatagcgggggcctttgatagtcgtgtcctggatatgaatggattgatgcaagttattgcgcaaaaagtcgtgcatttgaggtgtagtatgtgtgccaaagcaatccagttgcctcgtgggttcgactgacacagtttcattcagaaaactcatagggacaggcaactcgtctcccttctggacctccagagcgctgaaatcaatggattccttggccagcctagccggagtgcctgttttcaaacgccctaactgaaagcccacctcattttgtagagtattgctgatcccatatgttggctgctcgccaattcttcctgctgcaatacgcttgtcgccgatgtgaatttcagcactgagaaacgtacctgtagtgattatgacctgatctgccccaacctgggtaccgtcatccagaaccacacctttgatgaccttgtggccacatccggggtcatacaagatcaagtcagcaactttgttctgcagcagagacaggttggggtgtgctttcttgtcggaaagttccctttgcatgtatttcttatataactctctgtctatctgggctctgggcccccacacagcaggacccttgcttctgttaagcattttgaattgcactccagcgagatcagttactttgcccatcagcccatcgagagcgtcgatttcctttacaaggatgcccttacccactccaccaatagaggggttgcacgaacacttaccaatatctgttaatgacggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgtttagctggtattctgcagaaactattggatgccctcaaaatttaagtgaagaattaaaccgcacttatccgtctgtgaaagatgccaccatacgttaccaaccataaagaaagtggccgcacagaggtaccttagagaagccacaagggctcgattacacggtggcgatcaagagccatacaaaagtagaagacccccggatgaagaagcacctctttgtacgttccttttgcaacgccatatctaagtaacaagaaagaagccacagcattactacaatccctcacagggacagacaaatatcataaacttgaatctactatatcatactctaataactacctaagcgttaagaaatcgtctaatcttcaactgccgttgttcatatcctgactaatagtggcagtaagcagtcttttttttttttttctaaaatttttcatttttttttcagttgactcgccccgtcggtagtgacaagtgccgactgactcgtgtcctggtaataacagcaataatgaatatgcgatgggcttgaacttggtatttaaactatgttcagaggcaagtgcaaccgctgttaaccgtcccaggagctaccactagtagcgcagttatttcttattactttcttaatcctagcttaagagaaccattctccctcccctcacaatgctcaacattctcgttttaggaaacggtgcaagagaacacgttcttgtcaccaagctggctcagtcacccaccgtgggtaagatctatgtcgctccaggtaatggagggaccgcaaccatggatccttcgcgtgtgataaactgggatattacgccagatgtcgccaattttgctcgtttgcagtcgatggctgtggaacataagatcaacttggtcgttcctggtccagaattacctctagtcaacggcatcacctccgtgttccatagcgttggtattcccgtttttggaccttccgtcaaagccgctcagttggaagcttccaaggctttctccaagagatttatgtcaaaacacaatattccaaccgcgtcttatgatgtcttcactaatccagaagaagccatttcattcttgcaagctcatactgacaaagcttttgtcatcaaggccgacgggatcgctgctgggaaaggtgttattatcccatctagcatcgacgagtccgtccaagctatcaaggacataatggtcaccaagcaattcggtgaagaagcgggcaagcaggttgtgatagaacaattcttggaaggtgatgaaatctctctactcaccattgttgacgggtactctcacttcaatctccccgtcgcacaagatcacaagaggatctttgatggcgacaagggcttgaacaccggtgggatgggtgcctatgcccccgctcctgtggccacaccatctttgttgaagaccatagattcacagattgtgaagcctacgattgatgggatgagacgtgatggtatgccctttgttggtgtgctgttcaccgggatgattttggtgaaggattctaagacaaatcaacttgttcccgaagtgttagaatataatgtcagattcggtgacccagagacacaggctgttttgagtttacttgatgatcaaaccgatttggcgcaagtgtttttggctgctgctgaacatcgtttggattccgtaaacataggaatcgatgacacaagatctgccgttactgtcgtagtggctgcaggtggttatcctgaatcatacgccaaaggtgacaaaattaccttggataccgataaattacctccacatacacaaatcttccaagcaggtaccaaatacgattccgccaccgattctttattgaccaatggtggtagagttctttctgtgacctccactgctcaggacttgagaacagcagtagatacagtatatgaagccgtcaaatgcgtccatttccaaaattcttactacagaaaggacatcgcataccgtgcgttccaaaactcagaatcatcaaaagttgccatcacatacgcagactcaggtgtctctgttgataatggtaacaatctcgtacaaactatcaaagaaatggtcagatccacaagaaggccaggtgcagactctgatattggtggttttggtggtttattcgatttggctcaagcaggtttccgtcaaaacgaagataccttactagtaggtgctacagatggtgtcggtactaaattaatcattgcccaagagaccgggattcataatactgtcggtattgacctggtggccatgaatgttaacgatttggtggtacaaggtgctgagcctctattctttttggactactttgccactggtgctcttgacattcaagttgcctctgattttgtgtccggtgttgctaatggttgtattcaaagtggttgtgctcttgtgggtggtgaaacttcggaaatgcccggtatgtatccacccggccactacgatactaatggtaccgctgttggtgctgtattaagacaagatatcttgcccaagataaatgaaatggccgcaggagatgttcttctgggtctcgcctctagcggtgttcattctaatggtttctctttggttagaaaaattattcaacatgtagcattaccatgggacgctccatgtccatgggatgaatctaagacgttaggtgaaggtattcttgaaccaacaaaaatttacgtcaagcaattattgccatcaattagacaaagactactactaggtttagctcatataacaggtggtggtttagtagagaatatcccaagagctattccagaccacctacaggcccgcgttgatatgtcaacctgggaagtaccccgtgtcttcaaatggtttggtcaagcaggtaatgttccacacgatgacattttaagaaccttcaacatgggtgttggtatggttttgattgtcaagagagaaaacgtcaaggctgtttgtgattcattgactgaagaaggtgaaattatttgggagcttggttctttgcaagaaagaccaaaggatgctcccggttgtgtgattgaaaacggaactaagctttactaatcaacaatattaactttataatagattcatatatgcgcgtacatatattatatacaatttttctacacaagaatgcttaataaagatacgataattttttgttcgcttttacttttccgcataattcttccagaaaaatacaataataaaaggacaattaatacctttaacgagcgtaaaatagtagcaagagaatactgttgaggagttgtagcgaattagctgtcaataatggaccaagaaggccagccattgctttcaaaagattttcagcaggttttactggctactgcatccggaaacaattcatcgtggacagaaagggctgttctcaacaatgaaagtacagatgcagtgaaacacgaacctgcgctgggccaaaatgatgtgtttgatttagatcctttatcctttgataagtgggtaccttttttaagaagggctcttgataaaaatcaattggaccccgtaattgatgaattggaaaattcaattgaggataactttcaaggtctggaattgcaattattacaagattcccaaatgaatgataagctggaaacatctatagacgaaattgcaaacatccaaggtatggtgcaagacactttatccagtgaaatttccaaatttcaaataagattgagtgaatcagctaatgaactaattgtcaagaaacaaatgtatgttaataacaaaaaaatttcactaaaaatttcagaagcaacaattttaatcactaaggttgttagaatcttggaattatccagcaaatgtcaagaattgatcaccgaaagaaagtttttcaaagttttacaaaacttggatagtctggagaaattgtatctacaagaatttaagaattataatttccaatttttaattgaaatttacaattctataccatttttacagaaagtcaccaaggatgagtgtataaatttgataaggaattctctaaatttaaatttagggaagaacttgataaaagtggggcaagaattcgtggcaatttatgagaatgaattacttccgcaatggctcgaaacgagatctaaaatgaagttgacaaatttcaaatttaattcgcctatagagatctccatgagagatgaatcctttctagcaaagctaaacttgggtgaatttttccagttagatgactttcacgattctataatgatttttcaaaacttaaatgagttgagcgtcctctctggagagtttaacaaagaatatgaactgagaaagacaaaactaatgtatccattgatatggaagaagaataaaacagctgcatatcaaatggattcgttattacggggtacaggtactactcctggatcaaccgcgcatgacgtttccacagatgatcctttcacacaaagtctaagtttacactttttgcaggattactttttgaaaattctcggcttcttattatatgatattaatttgaataaagctacagaatttatcctcgttgataataactataattctacaaatgaattttgggatggactcatggacaggttgtcaccatatttgagttatttcatagatgagaagctgaaaacagaagaagacatgattaaattgaaagattttctttgtatttatgttgccattttagaaaatttcaaactgaacatcgaacctttatataaaattttggtttcaattttcgagaaattctgctctgtttccttgagagcttttgacgatgaatttcaaatcttgttaaacgatgatgattttatgcctttatccattaatgacaagacattatatgagaaagttttgaagatttgctggatgaaggagggcgaacacctttccctgccagatccaaccaacggagagccatttgctgtgactttgcctttttctccattatacccaatgacgtgtacacttgctaagaaaacatattctaaaataaccgcatttctttccatattttatcgtcatgagctacacactttgaataatattttggtcaaaacaatggacgatatatttaatgatatcgtcaataaaaaaattcgttctaaacttgaaagtacgtcgagagaagaaattgcacaaatcttagtcaatttagattattttatcatagcagcaaaagaatttagtaacttcatgacaagagagaatattttacaaaacccggatatggaaatacggttatcctcgataaaatatcttgcggaaagcagaaaattggcagaaacaaagttaattgaattaatcgattctaagatatcagatattcttgaaactattgaaattgactggcaaataacggaggtaaggcaagacccggatatctccatcattgatctggcacaatttttagaaatgatgtttgccagcacgctacaaaatttaccatacagcgtccaaacattattgattttccgtgaatttgactccttgacgagacaattcatgggtctattattgcatgacacaccaagtacaattacacatgaaagcataatgaattttgaagttgatgtcaattatttagagagcattattcccagaattttcccctctacaccaggtactatagatagtaatggataccagtcgccaatgaccccttcgacgcctacatttccaaatgccaacggtgttgacgcaccaacattatttgaaaataatatcaaatcgctagaagctacatttatggagttgaagcagtgtatagagttattaaagactcagggaaaagattataatgaaccagaaataagattaagaaaatattcaagaattagacaggaagatgcggctcttttgttgagcaagattcagcacttcgtctcatctgtagaaggagctaacggcgatgacactagcgtaatggatagtagcagcatattcaactctgaatcagcgagtgtcattgactctaatacgagtaggatagccaaattttttaatagacgttaaaaaattagatattatctcagtataatcatttgtacgttcataagaaagaatttcggacagtcttgagttttttggttttagtatcgaaaaagttcacttcaaataaattttttttttatcattgaataactctttatttttcacgtcaaccaaatacatctcaaaagtctactatatattgaaaagtatcatacaattagtgtaaataagtatcttaattatgggtgaaaaacgtaaccgtaatggtaaggatgcaaattcccaaaacaggaagaaagtatgtctgtctgcacacgaattagagttctttaagtactaacgatcaaaagtaatagtttaaagtatcttccggattcttagaccctggtacgtctggaatatatgccacatgttctagaagacatgaacgtcaagcagcccaagagttgcagcttttattcgaagaaaaatttcaagaactctatggggatatcaaagaaggagaagatgaaagtgaaaatgacgaaaagaaagatctatcaattgaagaccagataaaaaaggaattacaagaattgaaaggtgaagaaacaggcaaagatttatcttcaggggagacaaagaagaaagaccccttagccttcatcgacttgaactgtgagtgcgtgacattttgtaaaacaagaaagccaattgttcccgaagaatttgtgctaagtatcatgaaagacttagcggatcccaaaaatatggttaaacgtactagatatgttcagaaattaacacctattacgtactcttgtaatgcaaaaatggagcaattaatcaagttggccaatttggttattgggccacactttcatgacccttcgaatgttaaaaaaaattataaatttgctgtagaagtgacaagaagaaatttcaatacgattgaaagaatggacatcattaatcaagttgtgaagctggtcaataaagagggttctgagtttaatcatactgtggacttgaagaactatgataaattgattctagtggaatgttttaagagcaatatcggaatgtgtgtagtcgatggggattataaaaccaaatatcgtaaatacaacgttcaacagctttatgaatcgaaattccgaaaggatgaagataagagtgtaaaacaataatcatatatgaaacagaatagatattttatataagtatatacgctctcaatcggaaaaccattgtaatccattattataatgagcaattcgttcccagggtagccaatcacccttagcgttaggaatgagacccattgaatttagtttcctgtatccaatgtacattaagacgccttggaatacgatatacatgaacatagcagtttgcacttgactttgtgttgctttattacccaacactggtttgaatgcactccttgttgaaaatattgctttaatgggtccagagagtagcatgagggcagtcattataggaatgatttgtaaggatgtaccggacatatacgacataaaaatattcatcggaatagatttggctggttgtaacgcaatttgccatgccttctgtacttgtaatactgttatttggtttttttgtgccaaagaagtagtttgagatgtagcatcttgttgttttcttgtaacatttcctttagaggaattaccttcaaatcctggtggtgaaggtaatgtgtttgagttctgaatgttgtatttttcgatatacttggtgtccaataggtgtttagcccattcgtaaggctcctgttcactcatttctgttgcttatatcgtttggctttattttaaccttaactgatattatgttcaactttttttcattctatttatatagaaaagaatacgctttttttattatttatgaaaggaacatgaaaaaactacgaatgtacaaaagcagagattgctagagaatacattggtcaagaattttcgcatatggaacgcattgctcttttagatgggctgttaaataatcgtaatttaggttagttattgccctttgcgtcttccgtggaacaatgttggtccaataaattataaagaaaagaaattggatagcacaaataaaagagcaagcgataatgcaaaacattaaaagtctgttttccattagtttgtaatattctgaggtcatcaataaaaaccattttttcgttcttgtaaaattgtatctctcatctgtattggatttttcgaccatttgaaaatcatccttgctttttcctttatattcagtcgaggaatcatttgctgtattaggctctggttgagaaacctcttcaaggcccttttttgggtaggctttcaataaatgtagaacattgccggatagtgtaataattcccattattatggttttgttttgcctggtttgggcctgactttagttatatgattatttttgtatagatagctataagttattgaaagtaagctagacaataatttttggtgaatagttggtgaacattcctgaactacaaaggactattgttatatttagtttacttcaattggcccccaataggcttcgtaatttttacatgtcacaaaattaaataaggcaaaacgagaaacaaaatattaaaaatgtaggaaaaaaaaagtcaaaattggtttgacgacttaacctaatcaatttaagtcggaatgatgatcaacaataacatctttaattttatcatgaatatctaattcggttaattgacccaattcatctatgagctcggcaactttatcatgcaacttaacatcctcctcgtgaacaatttcattctcatccattgtggatggatgagctggtttactcatatcagctttttccaaaaagtcctggttagtattttcatcgctttcggcacagaactggcctccaccaagaattattgaacacattgtccttgtttcgttcaagatgtcactagaatatgacatccaaacttcatcttgtaagaaggcatatatatctggagcaattagatcggtcttataaattttggaatacttcgcaatttcttcggcaattaatactaattgacccatataacctaaatttgttttctctttttcgtaaaattcaaacgaatccttgtggccttgtaaaatgaaatcagagataatatggaagtctttaacaggtaacttttggttgctgccgtacaaaggttttgggataaatcttgtagactttttgaaatcaaacaaagaatagaccaaaaatgagttataagaaaaatccattcgaccattgaatatctgctgaataatatcaaatacaatgttgtgccaaaagttattccaaggatatcttaagaataattgtagaaactttggaaaaaacccaaggtcatgaagtttaattttgaataaatctccaatggtagggtttttacgtattttcaaattttgcgtttcactgacgtaaggaatttcaaaactcatatcatcatcatcatcaatattgtcatcagatgtatcaaaagtagaatacaattcattatcatgaaacttttttttaatattttttttttgtttttggttgtcattactgtcattactatcattattattacatttatcttctaatgtattggaagtaatagtattatcatttatatttaaatttttcatggctttctctagtgagttttgatcaagagtgtccctgcatttatctctggtacgtgctattttttcgcctctttttgaattcatcaatcccatatttgaacagtgtaacatttccgatatcaattctgtaatcttgactctttcaaagcccaaaggcctgaatgattcatgcaattggttttctagtaggtgatgcttaacagatggaagagcttttgaagcagtgtcatgatcatcgtcatcatcattttcaagtttaattagtaatgcataaaaatcttccatatgcatagtgagctcatataacaaatggcccaaatagactggatctctttgagaaggcggattgtctactatggtggtacttaacaaatctacttcgtcatagtcggaattattcttcctgatcaactcaattataatagatacggcaactcccattgcatggcctctttgaaataagattatattaataagttggtcgacatattgcggagaggcaagctgtcttgtcaatcggttaggtccgatccacaaagtatccagtttaaaattggtggaaatgctgatcagtgcttttagaagctctccgctactgttttgaataccaggtgagtatttgctattgtccaagagattcaaacacttaggtatcagatcctggtgatacaagaagtcaataatgttcgtaggtgattcaacttgatcagtcagcatgattttaatgagaaattcaaccaagggtgagacttcaatatgatataagaacttgtccacaatgttcggttgcgatttgaaaaattccaaatagctagatgtctgttcaaacagaagagtttcattaatcttaaggaaaacagccaagataggacaattttctgcctcaatattttcaaactggaaaacctcgaacagagaggacaaaaatggggtattttgcacgagtgcctccactatgggcgcacttttcgaacaaaaaatactggaaataatgttgacatacagcattgggtcttcatcgtcctgatcttcatattcacctgtttgatggaatgaattctctaaaagaaatggggttctataaccagtgcggtctatgtccttcaagtaagccatcagcatgcccactaggtagtccatgtggcggacctgctgggaacggtcgtcatagaaatatcccaagcaaatgaagtcgacgagtctgtcgttggctcctccattcagttcatccagcaaagctgtttccaacaagatcctatcaataaatgactggttaaggtcactcctatcccgagactcggtaccaaattcggactctgactccatagaaggctcattcttcttgtcgtcagttgaagaggtctcatttccctccaaactacgaaaaattagatagtactcttcaagtatcgaatcaattccagaatgactcagcgtctctccaaagggccatagtgacatatttttattttattttagctttatcgaaaagcaagagagcagtaaactgaacggtatagaagaaaagagaacttaataacaaaagaccagattgtctataactttatctcacaccaaataccaggttgtccttttcccgctgggtgaagcaaccgtttcacttattcgcacaatccaattagtagaacacaacacaacacaacacaacacaacacagcacaacacgcttaccaaattatatttactacggcaaccaaaaaccgacagaataaaaaacagccatcatacgtggacgaactcttggtttattgtctgttattatcctcgagagttcttatttaggggatttagggctggcatcaataccctaactaaaccctgaactgcccaaggaacaattttcaaaagtaagaaatgtcctatacgtttctatgtataaccctaagatagtcaggtttcggaaataaggcggatttctacgtacatgatgataatcatgtatcaaagaaaggatcaacttgaagaacagccttaaagtaagcgtaatgggcattctgtttcaaccaccatttctgaagtactttatatcttggatgcacaaaagctgttacatctaaacaagaacgcagcgtaacgaaatgggaaagctgataaagttaatcacgactctgacggtgttggtatcgttgcttcagtactgttgcgaattcaatagtgggagcatatcgtgtgaacgcacgcaaacgctttgccattataccaatccaagagtctggaacacctacttttcaagaaattgtgaattatacaaaaataaagttagtcccggtttcgatatagtggcgcgtaaatatgacacggctgtcaaacctgtcatcgatgacgctacagtaaaagtgaacaaggtcgctatacagcctgcattcaaggtcatccattcacaatgtaagaaatggaactgtggaaagtattaccaattggtccgctccccaatggtcaagactagacgatttttcttcgcaaaatacaatgcttttgtgaaacctaacatagacaaattctttactgcggagtttcgctctcatttgaaggaaagaattttaaagtgtaaaaatataggccattattactttactatcacttcaagatgcatcaaatccaaatacgactttattgttggtaatacagaggaaaaattaatgggaaagttcaagaataaggacacgcatggcattcatggttccgtcacacatgagccttcctcggaggacatggttttaaccgtaagtactatggagtctgacgaagaggagctaactacaacaagtactcaaacagtggttgaaacaattactttggaccaggaagaggctagcgctgttgctaatcatgcgcacgacgatgaggcttccacagacgttgaagactccacagacgtcaatgtcaatgaacaggctctgttgcaagaggattttgacatgtggagtgagactatattgcagaaaacacaagacgtcatacagctatttgaaaaggatgtttccaaatacatcaatggtaaattggttgaggaggccaaccactttaaagccaagtttcaatctttagatgataaatctaagaagttcttctccaagatttcgctagccattaacgatattgaatgtgtggaaggcattgatagtgaaactggcaagaaaattttcttcgataaatctggaagtactgagatttctcagtacataacgagagagttagttcgtgagtacttcaacgagacgcgctcgacgttagacgaactgacaaatgctatggagaaagatttgagcgaaatcactgatgaaattgaaaaaaaagttaatgcaattagagaggaaaacgtcgaggtatttgaagaatggggtgatatcattgtaaatgaatggtccaaaagaatggcttatgtggatgttatcaacgctcacatgggtgcagatgatgacactacgcttgatgaagagaaagcaaagtcttctgttaactggaagaagtttttgaagggcaagaaacagatcatagaatctagagacaagctggctcaccattccgctgacttatcccgtgttaacgcgtttaggcaaaaagtgcaaaagaagatattatcgttcactcaagagagtggtgagtttttgtatattctaagatcgaaagccaacctgcaatttcaggaacgtgaaagaaaggaacgtgaaagaaaagagcgtgaaaaagctgctgcagaagagttccaaaggcagcaggagctattacgacaacaggaagaagaagacgaagaagacgtatcctacacctctacttcgaccatcaccacaaccactaccatgacattgtgatgaaattcatgcgcttgctatacacacacacacacacacacacacacacacacacacacatatatatatatatatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacacacacacacacacacacacacacacacacacacaatatctatctatatatatatgtatgttctttattgtttgtctttacctttatatataaacatatatagccatataagaatataatattaccactccactgtattttgtatcctgcctatttttgctagattacaggacgcgcgagcctttcaggggagggaactgatgaatcgatcaaccaaaagaaagagccaaaggattggaccagaactgttactgttatagcagaaatattagtagtacgttaaagccaagcgtcgaatttcagcataattaagaggaaatgtctgaatatatggatgacgtagaccgcgaattcattaactgtttgttcccgagctacttgctgcaacagcctgtggcttatgatttatggattttatatttgcaacatagaaaactctttcacaaactgaagaacactaacttaatcaacgctgatgaaaatcccactggcgttggaatgggcaggacaaagttaactgctttaacaaggaaagaaatctggtctaaattgatgaatttgggtgttctaggcacaatttcgtttgaagctgtcaacgacgattacctgattcaagtctataaatatttctatccagacgttaatgattttactttgagatttggtgttaaagattcaaataaaaattcagtgcgagttatgaaagcttcctcagacatgaggaaaaatgctcaggaactattagaacccgttttatccgaacgtgaaatggcgcttaactctaataccagcctggaaaatgacagaaatgacgatgatgatgacgatgatgatgatgacgatgatgacgatgacgatgacgacgacgacgatgaatccgatctggaaagcttagaaggggaagtggatactgacacggacgataacaacgaaggagatggctctgacaatcacgaggaaggtggagaagaaggaagtagaggagctgatgctgatgtgtccagtgcacagcagcgtgccgaaagggttgcggacccatggatatatcaaagatctagatcagctattaatatagaaacagaatcaaggaatttgtgggatacatctgacaagaacagtggcctacaatactacccccctgatcagtctccaagttcttccttttcttctcctagagtgtcgtccggtaacgacaaaaatgacaatgaggcaacaaatgttttgtccaacagtggtagcaaaaagaaaaactcaatgatccctgatatttacaaaatactagggtactttttaccttctagatggcaagctcaaccaaataacagcttgcagctatctcaagatggtattactcatttacaacctaatcctgattatcactcatacatgacttatgaaagatcaagcgcttcttctgcctctaccagaaatagactgagaacctcttttgagaactctgggaaagtggactttgcagtcacttgggcaaataagtcattgccagacaacaagttaactatattctattacgagattaaagttctcagtgtaacgagtacagagagtgctgaaaatagtaacattgttatcggatacaagttagtagagaatgaattaatggaagcgactacaaaaaagagtgtttctcgttcaagcgtggccggttctagtagtagcttaggtggtagtaataacatgagttccaatagagtaccttctacttctttcactatggaaggtactcaaaggcgtgattatatttatgaagggggcgtttcagccatgtctcttaacgtggatggttccataaataagtgtcagaaatacggatttgatcttaatgtatttggctattgcggatttgacggtttgataactaattctacagaacaatctaaggaatatgctaagccttttggtagggatgacgttattggttgtggcataaattttatcgatggctcaatttttttcacgaagaatggtatccatttaggtaacgcattcaccgacttgaatgatctagaattcgtcccatatgtggccttacgacctggaaattctatcaaaacaaattttgggttaaatgaggattttgtatttgacattattggatatcaagataaatggaagagtttggcgtatgagcatatttgtcgtggacgccaaatggacgtttcaattgaagaattcgactctgatgaaagtgaggaagatgaaactgaaaatgggcctgaagaaaataaatcaacaaacgttaatgaagatttgatggatattgatcaagaggatggtgccgctggtaataaggatacaaagaagcttaacgatgggaaggacaacaatctgaagtttcttttgggagaagataataggtttatagatggaaagctagttagaccagacgtgaacaatattaacaacttaagcgtggatgacggttcattgcctaatacattaaacgtgatgataaatgattatttgatccacgaaggattggtggatgttgcaaaggggtttttgaaagatttgcaaaaagatgcggttaatnnnnnnnnnnnnnnnnnnnnnnntaaagatgttatcaggcacaatgaaagacagatcatgaaagaagaacgtatggtaaagataaggcaagaattaagatacttgataaacaaaggtcaaattagcaaatgcatcaattatatcgataacgaaattccagatctgttaaaaaataatctagaattggtatttgagttaaaactagcgaattatctggtgatgattaaaaagagttcatccaaagatgatgacgaaattgaaaatttaattttgaagggtcaagaattatctaatgaatttatctacgatactaaaattccacaatctttgagggataggtttagtggacaattgagtaatgtctctgcattgttagcatattccaatccacttgtggaggcaccaaaggagatatcaggatatttgagtgacgaatacttacaagagagattatttcaagttagtaacaacacaatactaacatttttacataaggatagcgaatgcgcattagagaatgtaatatcaaacactagagctatgctttctacattacttgagtataacgcgttcggttcaaccaactcttcagatccaagatattacaaagctattaacttcgacgaagatgtgttgaatttatgagcataaaacaagcaccttcaaacaacaaagccatgtgatatcagtcattatcttcccaaaaatcgcatattaatatgtcttaaaccgtttatataatgaaatttacttgacacctttctttttaatattctcatccaaaatacttcttaagtatagtatataatttcatcgataattcctttataggccagcgaagagccactagacgtagacaccgaaagaattcgaagcaaaaacagtagtcaagccagcaaacaagctgccaattacacttaaaattgtgtagaagaagagtttcttaatgtatgaagatttagaaccgacggtgaacagggcagatgataatacagctaatgtaacgattaaaccacaaattgcaaattttggttgagtatctaagtggataaatggctggaagctctttgaggaatggaactctttcttaagtgattacacaaatgccgagaaggcgaattggctatacttgttagtaattatgaattagaaaacaggaagggaactattcattatcctgtgtgttgttaaaaacatcaaaagaatagcatcaaccagcgttacaggcaacgtacgtataattgttcataagtcattgtaaaccttgaatatgcagggatatctctcactgcttatgttttgcctatttacagtatacgttttatgtgtacttgcatccttcttcgaaaagtatttgcaatttcaaatttcgcgtcaaagaaaggagaagaccacccaaaagatatcttcaacataggtagaaataaggcaaaagatgatgggacgaaacggtattctgctagcactgaaaagatctttcagcacttatcagccaccggtagtagagattacgaatataacgaagttatggcctactctacgacctgaggttagggatgaaatcaaggaatacttacgatggaggatggaagaagattggagacatataccgctggaggagaccaaagcagcgtatttcttatcttatggaccctgtggtggcagatccaagggcaacgaatggaacgtagggtacacgggaatgcggatggtgttcaaccttgttttatttggcggtgcagcgactgcattttataattggaaacaagataaaaagctggaggaacaattaagggatcttgtataaattggaagcaacaatagtatatatatatgcgcttgcgcagagtacgttctattcattttttatcattcattatctatccctgtaaataaactaatataaaaattcaaaaaaaataatgatttcgcccaggatcgaactggggacgttctgcgtgttaagcagatgccataaccgactagaccacgaaaccacttaattgaaatgtacaaccccaagataagatacttggttcatagtttagttgtaaaattgaagttcagtacaacatggcactagtataataaaaaatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagaacttctagtatattctgtatacctaatattatagcctttatcaacaatggaatcccaacaattatctcaacattcacccatttctcaaaaaaaagtttaccagccattactgcgcacttacctacattagtcactcttagcgtatattctaaatacgcttagagacgtctccttactatttttcatacgtataactctcaaaggacagtatagacatatccctgggggcttttagagtgcagcctctggaggtctacacacgttaatagtctcaaaaaatacgctaatatttgttaaataagcgaataggtcttcatgtgcgcctgaatcagtagctgtctacatggtaaagagtaatttgttgacacgaaaattgatagttggttaaaaaatattgcagattcaatactacatgaaagacttaattacaagatagactgatggtgaaaaaagaatgtacaggtttaccggcaaacattttgagaaattaaagcccaaaaaattttgtgtaccttatgattttcctcctctgtctaatccagttccgtatctgggtactgctgcttctttgttaaaatcgcagcatgcttcccattgttgggaattgactttgagcaatatttagttagtaactaccatataggtgactgtcgtgtgccagctataacagaaataatcctttcaccatgatcattgtaaacgatcaaagaaaactctgaagggactataatgcagtcttcatgcagacacttgaaatatacgacattagtagctcccaaggtagtaggcacatcctgcgtaaattctccacaaccatgttgtatatatagcagccatagtatgaccgagcacatgggacgtacgaataaaagattttctcagatccctgaacttgagcgtcaaccatgaatttctctacttttttttcgagcagtaattaccattttaggtttgattacaatcacagcttcagcagaatttgatttcgacgtaggctatgaagagtttgtccgtatcaaccctgataagaccttcttagaaagtgagattggcctttacgttggttggaccgagggtagtcaacggcagataacaacgataccacataattccacgttggcggcatcactacaagagtagaatggttgtggtggtaatggcacagaaacctccatcgctacgtccacacttacgatgagtggtatacctatcgctacgataatgaagcacagaaaaagtgtacttatcatattaccgcaactatgtacgtgaggtgtaaattatggctctcataggacataagcaggacagaaattgaaatttttgtgttggcagagcgaaagaaacttgaattcatttatgaggaataaattctcagctgcatccgtggttccagttgacgctatgatacgcaaattcctttgtgatacaggtaccatttctgctattcctggtagattgttgatcataccataagattgatgctggggaaagtggagaagctaacttaacgattgaggccctggcaaaccctgttaaaccagtactatcggccttaacatgcgacttagagagagagagatgtttgcgtttgcgtcatgatagagatgctacatccacatagttgttgtagacatgtttaaaggtacaattctgcaacaacgccttgaaattttccaaaactaaccaagcacattggagttacgcttatatagtaagccacttcacttgcgttgctgtaaaggttgataactacaggtaggaattaatgaatgttaaataaaaaagggaaataccatcatctcgacaagaaaggcaaaataacttttcaatctcaccaagacgcgcgaacgaaactcgtgcgtctatattagtatcttgacggcgcttttacatcattaaaggtgtaataaaactgaagtcatgcgatggcactgaaataatcaaagtaactatttgtgatggcatgcactgtgatatgatctcaaggaaaaaaaatgcaatgtcgggcgccaatacttatgatcatgcttagtctcgacattgaccttgcttgctacagtaatctggtgtccgagtagtgacatctaggtaccggtgagaactatttcttcattactacacttgtcgccccctgaatattatcactacacacgcgaaagagctcttgttaaagttactctcgcatcattgcggtacatgttttgcatattcatctgaagtaggaaagggtataaacagtatatgatgtaccatctgcataagcggtgtttaatgcgtacctatcgtttaagaacaaaaggaacacacccacacccgctccaataccatattgggagaataatgaggtaacatatgcttctatttggttcgataagacggctactagtccaaaaaaaagtcaaacaacaatttcaacagctacattctgaagatagaacgcatttttgcctgaatattgcaactcaatagacattctaaagtgctacgagaaaaaagcttgtaatggaccatggcaatgtgcgccatatatatatgcggctcccttatgagtagaagaaaatatatgactggtggtataaagtggcatggtggtatataaatgtagaaacaccatttgagtttgccataatgattaaatttccctttttataaagaattagccgcccataacacgaaaatatcacaattgacgaaagaagacacgtcgcctaaacgcgtaatgaatcgcaatatacgaaaagctaaacgcgtttttcagaatcctcttacccagccttggataatagttttggccgaaaaaaaaaaaaagaaagaaaaaaattgaaatttcgcgatccgaacaaacaatgaacagaaaaacagaatatatataacgctgccaagcctatttcttgttgccgattaattgttgacatcctcttaattaccaaaagagcctaagaaaacaaacacactaaccacacagtacctttcgcccgaatgtctgaattgaaaacaggtcatgcaggccataacccttgggcttcagttgccaattccggtccgatctctattttatcctactgtggttcctccattttaatgacggtgactaacaagttcgtcgtcaacttgaaggatttcaacatgaactttgttatgcttttcgtgcaatctttggtttgtactataaccttgattatcctacgtatactgggctatgcgaagttccgttcattaaacaaaacagacgccaagaactggttccctatttcctttttactggtcttgatgatctacacctcttcgaaggctttacaatacttggctgttccaatttacaccattttcaagaatttgactattatcttgattgcttatggtgaggttctcttttttggtggctctgtcacctccatggaattgtcatcatttttgttgatggtcctttcttctgtcgttgcaacttggggtgaccagcaagctgtggctgccaaggctgcttcattggctgaaggagcagccggtgctgttgcctcctttaacccaggttatttctggatgttcaccaactgtatcacttctgcattattcgttcttataatgagaaagagaattaagttaactaacttcaaggatttcgacactatgttttacaacaatgttttggctctacctattctattactgttttctttctgtgtggaagattggtcttcagttaatttgaccaataacttttctaacgattcgctaactgctatgatcatcagtggtgttgcatccgtcggtatttcttactgttccggttggtgtgttcgtgttacttcgtctactacatattcgatggtaggggctttgaacaagctgccaattgccttgtctggtttgattttctttgatgctccaagaaacttcttatctattctctccatttttattggtttcctatcaggtattatttatgctgttgccaaacaaaagaagcaacaagcccaacctttacgtaaatgagaacttacggggggtgcaatttatttttttttttggtttattttattttatagaggcatctaatgcaagtagatctatatacaattatacttaaaattgatataccttagaacaggtcgggcacaacgtgtggtaactccaatatatcactaatgacaatagcgccttctggtgtttgccccaaaatttcatttacttcattctcaactaaatgaatacatgttttcatgcccaatttgatacctgtctcgatgtttttcccactgtcatctataaaataagcattctcgtatcttgccaacccgctttccttcatggctttttcaaatgatttaacatgtggtttgcagaccagcgtatctgtcctagagtagtcacaatatgtcaatccatcaaataaatccgctatacccaacaatctcaggcaacgtattgcgtggtttttataagcgttggtgaaaagccacaatttatcaatctttcccgattgtctcaatctcaacagcatattccttaatggtatatcaggtttcaagatatcttgtagtggtaaggaatcatccacaagccggttatattccagtgcgttcactttgtggaacattacaagtccccttatggcaagtccatactctttgtagtaagagttattcaaaacgtgagcatcttcaggtgatagtttcaagtgtgtttgaaagaacctcagtatagattgttgcataagatcatgaattctcgtggatgatttatagagacagttgtcgatatcaaaaaagaaaacttttaagttcgggttttgaggtgtagcagaaatatcttgatcgatcggaaatgtcactttcgaacctggatgagtcaatgattcaagatgtgctttattcttggcaatttgttcgttcacctcattctgataggttgccaaatcggatgcagtatattcaacagtcatggagcctagtaatgattcggtccaagagcttactcatgtattccgaaattaattcaggtgaaatgggggagtaatatgatatcaagaaggcgatcacttattgaagttcacacagatacacacagatacacatatatatatacatatatatatatgtatatgtatatatcaacgcccataccattatcattatcaataagtttgcgaggcgggtaccctccctcgtgctactatattactgttgccttaattgagtaatttgatcgatgactaattgcaagagattgtgattgttgtacgaagttataaaatcatccacaacactcgttgagttttccagtggtgaaggtaagcgggatgagatctgagtcttaaactcttgcaattgagtgatcaatttatttctcaaatctgtcagtgtctcttgagggcatttatacaattctaagttttgtaggatttcaatcgtaggctgcaccgtttgataaatttgcaacgtggtatcattggttaaaccttttgaatagaataccgctgcatcaatatattgtttcaatgcatcatcatcaagtggagatacagtgccatcattgaggttcgtatcattatcatggaagatatctaattgatgaagagtttcaggctccttaagcttggctctcaaagtagagagtgtatccaaatgtgtgtttatttctttcacggttctacgaatgagatggtctctaaaggtggacgaattcacaaaatcgacaacaatcgcgtccttatattgctgattggagtaatattgatgatctttgctgttggcacttgatatcagtaacgcttgaacgttatcgttaaatagtgtctcgaatagggattcattgaatatagaaagtaaatcatcgtcccacttcgaggaaaactccgtgtttagtaaattgtatagttttacccactgtagtaaagttaagtttaatgtcttcatagagtccaccaagaacttctgtagtcgacaacatttgtccttgacaagcgcttcaaatttggaaggaactggtatcaaagataattcgtggaaattcaacagtagctcgtcgaatatccgcgacggagtagtggaagtaactatacgattacagaagttgttgatggagatggtccaatttgaaattactaaaatgttttgcgatggtatgctgactttttcttcgtcacgaggtggtgatatatgggtagtggtttggtatggtagtggagctaacttattcaactgaaatttttcatcattgaaacacagggatttaaaatcttgatcaacatttttcaaattgagcgacaagtcattaacagaatcggtcaagcttaagatcttgttatagttctttagcaaattcttttggaaggcctcattggttttagtcaaatcgttctgtaactccagttgataatctttaatctgtggaatatgagaatcgcgaaacaatggtaagacttcatccattttctatcgtattggttttttttaggttttctaccacaagatttgttgtacgaatgtgttatttattattcaccgccatgtttcatttttcttcagcataatgatgaactgtaacagaaaataggaaaaaaaaattgtcatctgagaaattgctttggatgaccagatccaaaacagacataagcattcgtataattggtacataggtatatatcaaataaaaatatgcattattctgaaaaaaaaaaaaaaaaaaaaaaaaaaaaaaaaaaannnnnnnnnnnnnnnnnnnnnnnnnnnnnnnnnnnnnnnnnaaaaaaaaaaacttggcttgggcaagtttttagcctcccttggaccattagtggcgaaagtggagcctgcataagagtgactgagttttttggcactgccattacaacccattggtattatcccttgagagccatgcggggattgtttctggttcagaagcagattctttaggttctgactcagtaaacgagtatcatctttgttgttctgtcgtggagtttctttattattctgtctgttttttttacctgaagtagttgtagaggaaggggaagaaggtggagagtgcttcttttgattaaatgatggtttcttgtaggaagaatggccgaagttaggtttctgaccgttaggaagagtttgaggaggtggtatatctgtgatatagttgttattattggcgttcttagcagcatttcccctcgcacgattatttctagttttttgtttgattagattatttgtcttgttcctgccagccgatggcaacagcctggagctgttgaaatacatggtatccgtcgacatgccttgtaatatttgtgtgagtatatttgtgtgctaagtgtaattacgttacgctttgctgagtacttcgtcttcaatacaaagtatgttattgtccttgttatttgaagacttttaccatttctatccgtatttctctatccgatacaacaacatcattttacacgaacagccggatgataaaactgtagtacatatggtatttgtgatatcctatatagccatataattactagcagctatgcaacagtcaaaggatcacaatccattttgcttacgactacttcgtggccctcatcttgcaacaagcccttcataacgtcttgaaggaatccacgctcagtatttgagtggttgcaaacaataacggtcttgcccatttctttccacttcagtacttcatgatgtgacatttctcccgtatagtaaaggtctacgtcctcttttagttgcttaaacacgccagaaccgctcccggcacagacagcgacttttttgattttgagttgattccatgcggatggagcagcaagagatgctacttgtacatagggaacccgtaaaacacgcttgacatttttgacaatttgctccaaagagatgtctttattgaattctacgaatctaccgtagccaatcaagtcgtcagtttcgccacttacagtttccaaggcataagactttgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatgaaaaggatgatattgttttattattaagtttcgaaaggagacggcattgaatctttttggcatagacgattttgctttcttacgttatttacatcggagagtatgtatttgtgtagttatgtgcttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgctgttactcctatcgaaaagtcgagactgaatcttggttatcgtagccaaatcgtactggctggaatctaacactgttttaggtaatagattgtgggaacagtagaatggctttaccaattgttttgatgatacggttgatgactttggttgtggaaatgattgcgaagagtagtaattgtttaaagagggcatccttgatataaatctgtacaagttttgtctttccaagcaaccaggtatagcggaaagagaattcatcacagtggaatgtagtgacagtgttgacctcgacgacacaatgcttgaaagacgtagcatgtttattggagaaagctcttgaaaatctgatccgtccaagattacattcctagacattgtagtttgttgatgatgatgctctcttttaccagggatggtactggtgctctcgccgcgattggtgaaccagttctgtgacgtgttgaagatcaaagaaggaagaacatccttgaacactacatgcatggactcttttagccttctctcaatggtgctttggagaatttttacagaacaatcaaacttaaaatccaaatcaacgtcattaaaggatatcccaattccagggttctttacaaaaatattcgtgatggcttctagctcgatggaactgaacgtcatagttataggaattgtgaacgatccattattgatgagctggggcatggtaaagctgggtgtatcctgttcgttaatcaataaaagattcgactctatgactgtctgtatccgcaacatagcatccttacatgaaatcttgcaaatccccttggccagagacttgggctgcgtgataatgtctaggtccagaatttctagctgtggtattgtaggaaaatccaccttctgtaccttaattccgcttttcaagatatctaatttctttttagacggtgagttcaaagccgtagataacttttcccgtactcgttcattgaaagagttatcaccaaacacagcttcgttgaatctaaatgacatgacgatgctgaagtttcttgcagttgtgtttttttgttataattgttaccgtttctatgttttacgaatcttccatgactcttctaattggtctctttttactacaaggcttcatggccctttttcaaacctaatttataagttctttgccctatgcttaaaacagtttagccctatttaatatagtacaaaaaaggaaaaacctaattgaaaaaagctattcaccctaggtcattactactttttcccttagctagccgtgtttttagtttttgttttgtttattttacctgtattatgccttgtttgatgactttagtatgggtttggtttgtcttatccttggatacaaaaggaccagatacattcacgtctggtcggtagaacatcggtatccagtatagtgttcagctgttcctttagagacaaaatttataatctgcgtgtaacaaataactgcaggttaaaaaagtccagatcagtgtttcgaagctgttgatttttttttttttttttttttttttttttttttttcatattccctgattgcatcgtttatctgattatcatttcattgcattctttaactacttgagttttctttccagctgtatactattgacactaacatgaacgtgcctgaaacaagacaatcctccatagtcgtagctataagagtaaggccctttacgtcaatggaaaaaacaagattggtcaatgaagctagtggtgcagaagctaactttcccggtttgggggattcgtcgttaatattacccatgagtaataactccgactccgatatagacatagacgctgaagaaggttctacgcggagcaaaagaaatagcttgctgaggagaagagtaattagaccggagggtatacgtaaaattgtggattgtgtggatgatagaatgctcatattcgaccccgctgatagaaacccattgaacaaagtgagtgatcaggtcctgaactcaatgcgtgcaagggccactaaggccactgcgtcttctatcaataacagcaatgctacgaacaaattttcttcgcaacgtcgaaggcacggtggcgaaattaagtttgtatttgataaattgtttgatgaaacctcttcccaagcccgtgtatacaaagagaccaccagcccgctcctagattctgttttagatggattcaacagtaccgtatttgcttacggtgctactggttgtggcaagacatatactgtgagtggcacaccttcacagccggggatcatatttctagccatggaggaattattcaataaaattacagacctgaaggacgaaaaagacttcgagatttcactgtcttacttggaaatatacaatgaaagaatcagagatcttttgaaaccagagacaccatctaaaagattggtcattagagaagatacgcagaaccacatcaaagtggcgaatttgtcgtatcaccacccaaatacggtagaagatgtgatggacttagttgtccagggaaacataaacaggactacgtcaccgacggaagcaaacgaagtatcttcacgatctcatgcagtgctgcaaatacacatcatgcagacaaataagcttgtagacttgacctcgcaacatacatttgctacactttcaataatcgatctagctgggagcgaaagagccgccgcaacaagaaaccgtggtataagattacacgaaggtgcgaatataaatagatccctactagcactgggcaattgcattaacgcgttgtgcttgaatgatggcagcagaagctgtcatattccatacagggattccaagttaactaggctgttgaaattttcactgggtggcaattgcaaaacagtcatgattgtttgcatatcgcccagcagttcacattatgatgagacattgaatactttgaaatatgcaaatcgtgctaaagaaataaagaccaaaataatcagaaatcagcagtctttgagtagacacgttggatcttatttgaaaatgattacggaacaaaagcgacaaatcgaagagttacgtgaacgtgaagagaagatgatttccttgaagctaacgaaatacaaactaaacaaagaaaagatccagttagccattaacgagtgcgtcaatcgtgttcagcaaacgtatgcaggcgtggaaacgtatcaagtagccaagaccttgaaatcattaatactttgtaaaaggcggtttttgcaaatggtcaagctagaagtggataatttgatactattatttgaacgggaggaaagtatagccgccgagatgcagccggtgattagtaattgccgaatgatcagtggtcagctttataacaaaatacacgagttagaaatgaaatttgatgaaaccgacactctgagttctgtcattcatcaggtacattccattgacttgaacaagttaagagagatggaggactgggatgaaacttacgacctagtgtacttggagtcgtgtttaaatcaaatatcagaattacaaagaaacgaaatcttggttaattcctccataatgacagaaaaattaatgtcagatccgggtttgaactcccgatttaaatttctatcaaagtggctgatgaataggacacctaacattgaatccataatccaagacctggttcatatcgacgaggagtttgaatcttttgccagaacttttatcgccaatcccgatagcaattttacaaacacaaatataaatataataaacacgacggcagctgacttggctgttcccgctgagaccctacaacgtcaaaatttttccaaaaaaaaagtaaagtggacgagtcccgaccttagtcccagccctatgattgaaccacaaccggagctagaaccagaactacaccaagatcaagacgccattgcaagtgaagtggacgtaagtatgcaagataccacattcaatgagcaggggccctcgaccccctccgctccgactacagcggttccaagaaggaagatgcgctcctcccttcttactcatcaaagtctactggccactgccaggaaataacatacatatcctacgtaaactatcgaatataacttctttccgccagcattaaacgcatttatgttgattaattccgggttacggggaaaatttttctttaatttcttttttttgaatttatttggcacgagaaaaggttcaaagtgaataattgcttttagtcattagacacattacctactttctaagagattctaaaagaaactaagcaccacaaatcattgatcttttaagagaaacgcacaaggatcatatactagattctcgttctcgttttttcttcctttttttttttctctaaagccttttactgggttaatttcctttattgacccaaattaaaagaaaacgtttctcaggagactcttttaagcaaaatttagcaaatttgtgtttgctgttgtttttacagagactgcattacttgaaggtttgcctttaagtcttcgagtcgtttttttttattagctttaatcctttttctgtgtgtttgtgtatattcagtggggttattttacagtattcgaagagacttcgtttcacacatttaaaccagctttattagcgtttagcttatacattacaaggaatttttttttttctttaacattattaagacagttattgagttaattcgtcttcagcccccctccccccaacaaaccccccttcatatacaaatggctaatactttcaagtattatcctgaaacgatgggtaattctagtggttatccaattagtttgccttttccgaaaggttcggctacttctgctgttaatgttgctaggcaactgcctaaatatttaggtcatgttccctcgcaatcagttcatactcagttgccatccatggcttctttaggttacttcaatcagccaagttctacttactatgctcctcctgcaccacttcaacagcaccagcaaccacctatccttccccctccgggcctaatgtacactagtaacaataacagcaacgttattcctcctcctgtccaaatgattcgggatggacaacaacaaccacaacaatctaaccaagtaaatgggggcgtcagtgagaacttggactacgatatttctataatgtcaaaatttatcatggaaaatgcctttgttgccttcaacgcgaactatagtactgatgaccagaccactgatctttttttcaagggcatatcttctgtgttgaatgccacgagattgccttcagctactatttttttggctatagattatcttttcaagtatatcaataaattatctaatgggatacattcaattggtggcaattcgatcaatatcatttatcaaaatactatgattgcgttcatattagcaaacaagttcaacgatgataaaactttcaccaatagctcatggtcacaggcaacaggaatactgataaatgtcatcaatgatttcgagagacaatggttgagaatatttaactgggaattgtatgatagtgcttttctttattttgagttcgtcaagaattttgagattttcaagcaaaatcaactcaaacctgctgtagcggttcctacgttattatctccaattgtcaacgttggtgatacgagaaacgtaaatttcaacttgaagcctacttccacaaacaacctattatctccagtttccaattatgaaacccccatgctgatgccgcataacatgttttcatcaccatcttatcagagtaactcaaggtctgaattttctagtatgaatggttattataactattacaactataatcagccaagattgaattactatcaacaattccccaatatatattcttcaccaatttcggaaactcagtttgattacgacttctacaatttcagtagtcaacaacaacagcaacaacaaaaacaacactcacttttacctgccgctccacaattacctccccctcacgtccataatcagtcttacggtcatcatcttggctggaagtcaatggatgacacaataaatcattcaagatttgagcgaagctactttccgtattcggcagtgtattaatgaaaacttttttttccttattttttctttgatcccatcgaattactttctcttttgcccaggatcatctttctaatctatcattttattattttctctcatgagaaaacagaatttcgaaacagatataataaaaaaattgaaaaatttgaaaaaaaaaaatctagaaacatattttcctaaaatgaaaatcggaagctaacaaaatttttgaaaaacgaaataaagaagaaagattattattattactttttttattagtactccatatggacctcttaggtgagtgatcttattaaaaaaaataataaaaaaatatgaaaaaaaaagaaaattaaaaactaaacaaattttatgacaggaataaaaactataaaaaatgaaaaccaaaaaaaaaaagcactggatttttaacatcttgtccttttctttccctttatcattttttctcatttactttgttattaattttttttttcaagttctccacatatacatatgtaagaattgagtctatctctttctaatatttaagaaatacataaaaaaaccaatttttttttttattactagcaaatttatttttgtgaagtgaaattcatacattggcttattaaaggtattaaatattactgaaattttatgaaccaaaaagaataatggatgattgtaaggttacatgcaatatatcaagatattactagagattatttaccgccagcttctctaaaccacctgatgcttctatctaaacaaacacagcataaactttcatttaaatcagctcccataccagatctccaaccttttttcaaaaacttcacgtcaaagacaccaggttcagctaaagaatctccatgttcatcaacagctaagatatcctcttcaatttcaatatcatcacaatgcatattcaatgtagtgattctttcctttgtttttacatcccaaaatctcaatttaccatcccatccggcactgcataatgtttcaccagaatcattaaacgatagactcatgacccagctagaatgtgcaaattcacccagacttgcctgcgagctatgggttggtacggataaggagcctattctttcaccaaattcagtttcatatagagtgatgcaaccaaatgaatttgaatcgtgagcaatggctaataaggatccttgaggagaaaatttcaccgatctgatggaattcgaattattaatcatagaatgctgagattcaaaattgtacaacgggcgtaatgtagatagttctgaaatttgtactgttccattattaaaacctgtggcaattagtcctcgttcagagatatccacagaagtggcaaattgacttggagtcataggcgattcgacagtgccttgtaattctaacgtggggctccaatttagtgttaaagaatttgactcatctgcaaacgggtgaaacttccaaatgtaagtggtccctttgacgtctgtagcaaccagcctatgggaaagtagtctgtcatttgaggcaccccattttaatgcccaaaaggaatgctttttcatgtctgagtctagaagatccaatttctcgaatataacttttttagtctcatcttctctagtgatacgatagaagagtaaatcgccagaaaatgaagtggtagcaacaaggcataattcaaatgcatctctctcaatagcttgcaagacatcgacatggtgcaatccggacttatggacaaagtgagaatatgacttatcttttggattttcattatctaacagcttattatcccacacctttaagtaaccgtcacctgaacaacttaccgtaaatgaattgcaagcagaaaccgagaaaatatcagcgtcatgagctttacctgcatttgctgtggcaataaacactttggacatttttccaatacttgattaacctctttttcgtttcttgtctttattttagatttgttttaatatcgcctaatttttccttctttactttatattttttttatttttcgcctaaagatttgtatcaattaattagccaacaaaaacaaaaacaataaagtcatataagggttgataattgatattgatggcagctaattctgtagggaaaatgagtgaaaagttaagaatcaaggtggacgatgttaaaatcaaccccaagtatgttttatacggtgttagtacaccaaacaagcgcctttacaaaaggtattccgagttttggaaactgaagacacgattggagagagatgtaggaagcaccatcccatatgacttccctgaaaagcccggtgtattggacaggaggtggcaaagaagatatgatgatccggaaatgatcgatgaaagacggatcggactagagaggttcctcaatgaattgtataacgatcgttttgattctcgatggagagacacaaaaatagcgcaagacttcctgcagttgtcaaagccaaatgtttctcaagaaaagtcacagcagcatctagaaactgctgacgaagtgggatgggatgagatgataagagatattaaattggatttagataaggagagtgatggcacacccagcgtgcgtggagcactaagggcacgtacgaagctccacaagttacgagagcgactagaacaggatgtgcaaaagaagtctcttccaagcacggaagtgactcgtcgcgccgctctattgaggtccttgctcaaggaatgcgatgacattggtacagcaaacatagctcaggaccgtggacgacttctgggggttgccaccagtgacaactcttcaaccacggaagttcaaggaagaacgaataacgatttgcaacaggggcagatgcaaatggtgcgcgatcaagaacaagagttggttgcactgcaccgaattatccaggcacaacgtggattggccttagagatgaacgaggagctgcaaacacagaatgagctacttacagcacttgaagatgacgtcgataacactggtaggaggttacagatagccaacaagaaggctagacattttaacaacagtgcttgaattaatgagttactatccgggttacaaatcctgagagtatatttgtactaaaaaaaaaattgtaaatctagtaattgaaaaattttggcgatgagacgatatggtaagagtaaagcaaaggaaccgtcatgtcgtttactgctccttcagatcccgtcaataaaccgacaaaagtgaaggtatcacagttgtgtgaactatgtcattcaagaaaggctctcattagaagacccaaaaacctgtctaaactttgcaaacaatgcttctgcctcgtgttcgagacggagatccataacactattgtagcaaataacttgtttcagaggggagaaaaagtagccgtgggggcctctggtggtaaagactccacggtgttagcgcatatgctgaagcttctgaatgaccgttacgattacggcattgagattgtactgttgagtattgacgaaggaatcatcggatacagagatgattccttggccacggtgaaaaggaatcagcagcagtatggccttcctttggagattttttcctttaaggacctctatgattggacaatggatgagattgtatccgttgctggtataaggaacagttgcacgtattgtggtgtttttagaagacaatcattggaccgtggtgctgcaaagctgggcatatctcacgttgtcaccggccacaatgcagacgatatggcagagacagtactaatgaatatcctacgtggtgacgtagcaagattggaaaaatcgactgcgattatcacacaaagtagcggctctcccatcaagagatcaaaaccatttaaatattcttaccaaaaggaaattgtcctgtatgcgcactacatgaagctggattatttttccactgagtgtacctatgccccagaagcgtttaggggcactgcgagagaatacatgaagaatctggaagcagtgaggcccagttgcattatagacatcatccaaagtggcgaaaatttggcattaaaggctaaaaaatctaacgctggaaagagagtcgtcaaatttgttgacggcaatagatgcgctagatgtggatatctgtcgtcaaataacatttgcaaggcgtgcatgttgctggaaggactggagaaaagtagagcccaagtggcaatcgagaatgacacttctgccgatggtgcagccttgaagctgagagctcttgagaaactcagcttttgacatatatatagctcgcagtagaagaatgcagcgtaacataatataatataatatagtacggcgcgccctccattagaacgcgcaacacaataaagacaaataaaagaatcagctataaagctggccattgcatggttcgcgctggaaagagaggaaaagcgtggtgataaagagcgaaccaagcatattgttttccaagaatgagcaacgaagattacggatacgactacgattatttatttaagatagttcttatcggcgactccggtgtgggtaaatctaatctgttgtcgagatttacaaccgatgaattcaacattgaatccaaatccacgattggcgtggaattcgctacaagaaccattgaagttgaaaacaagaagataaaagcacagatttgggacacggcaggtcaagaacgttacagggccatcacgtctgcgtactaccgtggtgctgtaggtgcacttatagtgtatgatataagcaaatcaagttcatacgaaaattgcaaccactggcttaccgaactgagagagaacgcagatgacaacgtggctgttgggttgatagggaacaaatcagatctggctcatttaagagcagtaccaaccgatgaagcgaaaaatttcgcaatggaaaaccaaatgttatttactgagacaagtgctttaaatagtgataatgtagataaagcatttagagaactgatcgtagccatcttccaaatggtaagcaaacatcaagtagacttaagcgggtcgggtaccaacaacatgggctctaatggcgctccaaagggtcctaccatcagcttaacaccggcaccaaaggaagacaagaagaaaaaatccagcaactgttgttaaaaattttgtgccctactaaggtcgcatggtttcatgcatattctgtctacatataacccccgttaataatgcttttataaatataatcaattacatataccttcccaagttatttattactaaccttcgttgcacgcaagaaaaaatgtattaacgtacatacattttctaaatagacctttcctgacgcctgcattttgcaatagccgaagataagaatatgattttttttttacgatttaaatattctgttgttgtgcagtctaaaaacacacgtgtatgtttttttccgcacgcatgagcagaattagacggttttataaacgttcgctctgtgtatttcacgtaccttcccggatacaaatttcgtcatggtttatattggaagtttttccgaaattgcgggttttgaaggtttatccgagacgacgtgaggggtaggcaggagaaggaaggctgtttacgtacgcaaggatggggtacgacaatgattcaatttctgttgctaagttttttgttattttttcatattggcctactcatctttgatatcattattttttcgaatctacattagagcgtgtttcggaaaacaaactcgctcgatacagtaattgcgttttatttacggaaattaccgttctcggttccaagaaggttagaaaaatctgttgtcgctctttctttcccccacttgtaaaaacaaagaaagtataaaatagtttatggcccttaaggcaggccttgttgaatttgagctatacctaccccaatgatagttctgtggtagtttgtttgaatatgtaatatgagaagcacgatggcaaacgataatcttcactgagctgatttacgagcgaccatcatctccacggtgcgaattaataagctgtggcgatgtgctgtagttgccctatcgcccctgcggagcttgcgtcaactagctctcccctttccccattgaagttagcgtattaccatcagttaatgattgataggctcatacgaagaagaaaaaaagccgggataagaaaccccgcctccacttttttggctcatccgaaaatttatccgcggagacatccacggagcacccgcaaaactgaagtaataactctaaattatatgccgctgagaaaaatctcgtacgaggatacggtaaataatccgtgcgagaaagtttttccgaaaatcattcccggtcaaaagcgtttctggtatataagcgattgggaaacccgtctataatacgtagtaacttacgatctgcctgtcaaattgtgtgcttgtccttgtactattaccattgtgtagcttatcttaactctcaattaagttttaactcacgctaagactattgacctcgagaacaaacaaaataaaaataaaaaaagagaatgcctaaaaagcaaacgaatttcccagtagataacgaaaacagaccttttagatgtgatacctgtcaccgtggtttccatcggttagaacataaaaagagacacttgagaacacacacaggggaaaaacctcatcattgcgcatttcctggttgtgggaaaagtttcagtagaagcgatgaactgaaaaggcacatgagaacgcatacaggacaatctcaaaggagattgaagaaagctagcgtacagaaacaggagtttttgacagtaagcggaattcctaccattgcatcgggcgtgatgatacaccaaccaataccgcaagtcctaccagcaaatatggccataaatgttcaggcagtaaatggaggtaacattatacacgctcccaatgcggtgcacccaatggtgataccaatcatggcccaaccagcccccattcatgcctccgctgcatctttccagcctgcaacttctcccatgccaatttctacatacactccagttccatcgcaatcattcacctctttccagagctctattggctccatacagtcaaatagtgatgtttcatctatcttctcgaacatgaatgttcgcgtaaacactccacgctctgtgccaaactctccgaatgatggatatttacaccagcaacatatcccacagcagtatcagcatcaaactgccagcccttctgttgccaagcagcagaaaacttttgcacattctcttgcatctgcattatctaccttacaaaaaagaacgcctgtaagtgccccttccaccactatagaatcaccatcctcaccaagtgattccagtcatacctctgcatccagcagcgctatctctttgcctttcagcaatgctccttctcagctcgccgtggccaaagaacttgagtccgtctatttagattccaatagatacaccaccaagactaggagggaaagagcaaaattcgaaattcctgaagaacaagaagaagataccaataacagcagcagtagtagtaatgaggaggagcacgagtcgctagatcatgaatctagcaaaagccgaaagaaattgtcaggcgtaaaattgccgcctgtacgtaacctactgaaacaaattgatgttttcaacggtcccaaaagagtttaacctttacggcccctttttatctcaccatttttcctctaacgaactgtcatgaaacaacttagcatataacgcgtacttacatagatagattaaatagataaccatgcatatcactaactagcatcgtcatgaatagcacgtttacctatacgaattgcggccggcatggtcttttatattgctcccttggaccgagtaaagatttaccttgcgttttcggatcgtcaaaatcttttagggaaaggataaatacaccacaagattcctgggaaatgaaaagtatctgaaataattgtgcttttggaagggtactgagagcagtgaagtttctatgggtactacgacaagtcatccagcccaaaaaaagcaaacaacaaaaaagtgtcgtgcacctatcatgagtgacgttagagaaaaacccagcaatgctcaaggctgcgaaccgcaagaaatggatgctgtgagcaagaaagttactgaactgagcttaaataaatgttcagattcccaagacgcggggcagccttcaagggagggatctattaccaaaaaaaaatcgacgttattgctgcgtgatgaggacgagcccactatgccaaagctatctgtcatggaaactgctgtggacactgactctgggtcttcgtctactagcgatgatgaagagggagatattattgcccagacgacagagcccaagcaagatgccagtcctgatgatgatcgctcaggccattcttcgcccagagaggagggacaacagcaaatacgtgccaaagaagcttcgggaggtccaagtgaaatcaagagctcattaatggttcccgtggagataaggtggcagcaaggtggttcaaaagtttacgtgacaggctcattcaccaaatggaggaaaatgatcggtttgatacctgattctgacaataatggctcatttcatgtgaagctaaggctgcttccaggcacacatagatttagatttatagtggataatgagcttagagtaagtgatttcctgcccacagcaactgatcagatgggaaacttcgtcaattacatagaagtcaggcaaccagaaaaaaaaccaactaacgaaaagataaggtccaaggaagcatattccatgcgacctcccaccagcgatcgatcctcaattgctctacaaattggtaaggatccagacgattttggtgacggatatacacggtttcatgaagatctttcacccagacctccgttggaatatacaacaggcattcccgccgtgtttactgacccgtctgtcatggaacgatactattataccttggatcgtcagcaaaataatactgatacgtcatggctgacaccaccccaattacctcctcagttggagaatgtgatcttgaataaatactatgccacgcaagaccagttcaacgagaacaactcaggcgctctgcccattccaaaccatgtggtgcttaaccacttggttactagtagtattaagcacaatacgctttgtgtagcctccatcgttcgatataaacagaaatatgtcacccagattctttatacgcccatagagtcctcgtaatccgggcttcctactttttaaacgcgtattttcttgtatatatttttggcagctatggcacactaatttctatttccaatttagtgtcagtagagatatagaagcatataacataatgatttactaatgggctcagtactctcaatgcttattgttatcacaaaccacgataccactacccggaagtcgcgtgatctttttttttcggaaaatgagaatcgccacttttctaacgaaagaatattgaaatcttaatattggtgagaagaggaataaaagtagctaagagagtcacgagactaaaaggtaaaaagttcagctattccaactttacttctttctgatattgcacctttcgtgaactagcttcgtgtatttaagtgaatatggaagagctgaatattgattttgacgtatttaagaaaaggattgaattgttgtattccaagtacaatgagtttgaaggttctccaaattcgctgctgtttgttttaggttcgtccaacgctgaaaacccgtaccagaagacgaccatattgcataattggttgctaagttacgaatttcccgctactttgattgcattagttcccggaaaggttattataattactagttctgccaaggccaagcatttacaaaaggcaattgatctatttaaagaccctgaaagcaaaattacgctggaattgtggcaaagaaacaataaggaaccagaacacaataaaaagttatttgatgacgttattgccttaatcaatagcgctggtaaaacagtaggtatccctgaaaaggactcttaccaaggtaaatttatgactgagtggaacccagtatgggaagcggctgtgaaggagaacgaattcaatgtcattgatatttcgctgggtctttctaaagtttgggaagtgaaggatgttaacgagcaagccttcctgtccgtttcaagtaaggggtcggacaaatttatggaccttttatccaatgaaatggttcgggcagttgacgaggagttgaaaatcaccaatgccaagttatcagacaaaattgaaaataaaattgatgatgtgaaatttttgaagcaattgagtcccgatttaagcgcattatgcccaccaaactacaaattcaactttgatttattggattggacctattctccaatcattcagtccgggaaaaagtttgatcttagggtttctgcccgttctaccaatgatcagttgtacggcaacggttgtattttagcttcatgtggtattcgttacaacaattattgttctaatattactaggacctttttgatcgatccatctgaagaaatggccaacaactacgattttctattaactttgcaaaaagaaattgtaactaacattctgaagcccggccgtacaccaaaagaagtttatgaatcagtaatacaatacatcgaaaaaaccaaacctgaactagtgcccaatttcaccaaaaacattggttcattgattggtctcgaatttagagattctaactttatattaaatgctaagaatgattaccgtaaaatccaacgcggtgactgctttaatatttcgtttggtttcaataatctgaaagattctcaaagtgctaacaactacgctttacaattagctgatacggttcaaattcctctcgatgaaacagagcctccacgcttcttaacaaattacaccaaagcgaaatcccagatatcattttatttcaataatgaagaagaagacaataataaaaagaaatcttcaccagccaccaaagtccctagtaaaccagacagaaattccaaaattttaagaacaaagttacgtggcgaagcccgtggtggtgccgaagacgctcaaaaggagcaaattcgtaaagaaaaccaaaagaagctacacgaaaaattggaaaagaatggattactcagatttagtgctgctgatgccaatggcccagatagtgaacctcgtcaatacttcaaaaaatatgaatcttatgttcgggattcacaactaccaaccaatattcgtgatctaagaattcatgtcgactggaaaagccaaacaattattctacccatttacggtaggccagtcccgtttcatataaattcatataagaatggttctaagaacgaagaaggcgaatatacgtatttacgtttgaacttcaattcaccgggatcttctggtggtatttctaaaaaagtggaggaattgccgtatgaggaatcagcagataatcaatttgtacgttcgattacactaagatctaaagatggtgaccgcatgagtgaaacctttaaacaaattgcagatctgaaaaaagaagccacaaagagagagcaagaacgtaaggcgcttgctgatgttgttcaacaggacaaattgattgaaaataaaactggaagaacgaaaagactggatcaaatttttgtgaggccaaatccagatacaaaacgtgtgcccagtactgtctttatccatgaaaatggtatcagatttcaatccccactaaggactgatagcagaatagacatattattctcaaacattaagaatctaatttttcaatcttgtaaaggtgaattaattgtcgtcattcatattcatttgaagaatccaattttaatgggtaaaaagaaaatacaagacgtccaattctatcgtgaagcttctgatatgtccgtcgatgaaactggaggtggaagacgaggtcaatccagattcagaagatatggtgatgaggatgagctggaacaagaacaagaagaaagaagaaaacgagctgcgcttgataaagaatttaagtattttgcagacgcaatcgcagaagcatcaaacggtttattgacggtggagaatacatttagagatttgggcttccaaggtgtcccaaatagatcggcagttttctgtatgccaactacagattgtttagttcaattgattgaaccaccatttttggtgattaacctagaggaagtcgaaatctgtattttagaaagagttcaatttggtttgaaaaacttcgacatggtttttgtttataaagatttcaataaacccgtcactcatatcaatacagttccgatcgaatctttagatttcttgaagcagtggttaacagatatggatattccttacactgtctcaacaatcaatttgaattgggcaactattatgaagtcattacaagatgatccatatcagtttttcttagatggtggctggaattttctggctactggttcagatgatgaagcatctgatgaaagtgaagaagaagttagtgaatatgaggcttcagaagacgacgtaagtgatgaaaccgcattctctgaagatgaagaaggatcagaggtggatgacgatattagtggtgatgaaagtgaggactatactggcgacgagagtgaggaaggtgaagactgggatgaattagagaaaaaggctgctagggctgataggggtgcaaactttagagattagactttataacacttactgggtttcaccagcaaaaccttgatctgacagaaaattactcttatgtatctgaaaaataatgatggtatttaggcatagtatttatcaatgctaagaaatgtaaatggactgaatgtacactcaatgctaacggtcaaggtcataggacgtttgcgtaataaaagaaactctactagagttgaacataatttgatataaaagtatataaattgaaaaggcagtttcaatcattttagtttctgcaatttatttattcctgtaatctacaattttatagttgggaaattctctcgaaaatattaagaaaaatacagaactcataaggtcttttttattggcattttgaaatcccctcagataatcaaagatgctaacaaacaaaataataaacggtaaaaaaaaaaataacacgatagggtacagcaaacgaattattttatccacgtcttaaaatcctgtgggttgaacgttcatcgcgctgttcatcagcatcaaaggttggccatctttgtgctcttcattagatccggactttttagcgagttcttcggtgattttcttaatggaatcattctgctctttttttatggagatttcaaatggcttaatgtagtcctccaaagaattcatccatgatatttctaaaacaaattcaattctcactaagttgtaagcagcatatagcaaagcaacaaagccttctctgttaccagtttcaacgaaatatgtgagtagagcctccactacctttggatcctgagagattgctgccgtctcaatagcgtccttccatagcttttcttccttcaagattgaaagactctttgcccacttcttatttctacggtataacagggctgctattttcttgaaaaaaattagcttatgagattccaaacgagatgccaatcccaattggtcaaatttgtcataagaatcaacagcgtcttgcaaagctttataatcttcttcttcaatcatcagatcgtggtaggcttggttgacaactgagttattttttggtaagacattgatcaagaaaggcttgattaaaggcaagttgtcggatttcgagaaaattttgacagttcttggaatatctaatcttggtgtcaatgaggtcaaaagatcaactagtaatgatgggtgaaatttgacgtagaaattaatggccttgtaataaatttctaagttagaaactttgacaacaacttctttgaaataggcgtgatccaagtctttggttgatttttcgattagtgttaaagcagcattatcccattcatcatagtgagcatataaaaagaccaattccgaccagaggtgagcttgttcgacagctctaataacctttggaatatttattctggaccagaatagcttcaagtgttcgaaggtcttgtctggttcatatttggaatacaaaatggccaattcagtgaacatgcccatatgagctctttcaagtcccaaaccagcttcaaacaatgaaatcagttcttcgaaatagccgtttgattcatacctttccaccagttcatctaattcttcagcgtgaacgatcaagttcaacccacaaatttgagccagcttgaattctttcttttcaatacaagcgtcgttaaccagtttccaaactttaatgtttgaagcctttctagcagtgtcaacagcagcctggtaatctcccaggtaaaccaaggtagaagcaagcttggagtaattagaaacagcagaataacatagtctggccgctttataccctttattctcgaataatttatcaccaacatgatctaagtttgcaacattggaacctgccaacaagttctcaatttcatgaatcttgtttagttcagcataggccaagattaaagcaccgtcgatctttggttctttcaaagtctttctagccattagtaaaaatggaattaattcttcgtatttaccggcttgttcggctatatcaattacattttcgtaatttgatgggtcttctgctttaatataagactcaatagcatctgggattcttaatccatctaactgagccgtaccgatttgagaccacaattcgggagtattgattttatcagcataagaagcagctctatctaaagacatgatgtcttcgattaaaacctttaaagctttgccgtacatttcatgtttgtcgtagatttcaaaagcttcctccttcaaatcatgttcaatacataatggagcaatttcatcggcgtcgtagttatctaatttttcgatatagcttgaaaccttagttggttcatacttaatagcagacaataatagcaacccttgtaaagccacattttcgttgaaaggagaaggttccaatatgattttttctagtaactcaattagctccagttttaatccattggtcatgaatgcttgaacagttaaggaaacaggttcaggatcagtcaattcagggataccaacggagatgaccgaatcaattaattgtcttctgtgaatattttcttgattcaaaactttgttccataaatcgagatcagaacgttccaacaaatatcttgcctggtacttgtacatgctattttcattagtgattctaatcaagtcatcatcattttgacctttttcatacgcaatatatgcaaggtagggatctcttttttcacagtaatgaccaacatctaaggtgtcatattggtcgttttccttcaaaaacttttcaggagaattattggaatcaatataaatttttgctaaggcattgtaaacagcttgatcctggataccttgacttaagctttgttctaggaaaggtagcaatatttttagtctatttctcttttcaacctcagtagttaattcatcaatagggacttgacctaagactgattgtagcagactttgaataaatgcctcatcacaatccatatcaagtaatgcgccaacaacttgggcagtctttgaagggttaacctgctgcacgtaagtttcaataaattttaagttctgcgatttgtacaaatataaaatcatttcatgaacaaagtcgaaacggtcacaaactatgactagaggcaactgatcttctagattggcatccttcaagaaattcttgactctttctggatcatagacattgttatccttcacaattctttcaatttctctgtattgcttcattttagcagcagcttcaatgtatttgtaaaccacatctttatcttcggttaggttgactaaagaggctaagtaatagtataaaccttccgtagcattataatcttcgaataatttaattaaagtagatggaccgatcaagtcagagaatttagttgccacctgtactacggtctggatgttagcctgaatattgttatccattaaagcttttaagcatggcaaagattgttcaacgttcaacttaccaaagtatccgactaaccaatcgataggcaatgcattggtgtggacaacgcatctcttgatatctttgatgtccgtgtaattttctaaagctctctggtatagtcccgccttttcggataaggaagcaatagttggtttgtcataatgagaaaagatgttgtttcccaatatggcgtcagcaacttgtggtgcgtgtagtagattgacttcaagaacacgagtttgcaagtgaccttggtctggggtatctccttttaacgcgtctagaagtagagaggttccttgttggatatggttttgggaaaagaatagatctgcgattttttctatgtcgatctgagaagcagtttccggattttgtaatagagatacggcaaattcagaagctctgtctggtgatgatctaatcaaagaagaaatcagcactaaaaagttaggttgatatccaaccttttggcagtaaggaataattttttcaaactgttgtaattcggcaagacaagatataacttttgcatgggcacctgctcttaagtagcaagctagtgctaaagtagtatcgaaaggcttaacgatgtcacctagttcttctgaacattctagtttatcttcctttaaccatttttcgaacaattgttttctgtcttgttgtagaactggtctagccaattcaattgtttcctctttattcagtttccctttatccaatagtgttgaaaagtaaagtaggataggagaaatggcgcctggtggtgcttgaatgtttttcaacctgttgatggtgttttggtttcttaaagaagtggaagaggctgcaactttagctgcattttgataatcgttttgtaacaataaagattcaaactgtttttgaaataaatcatctgcacctggtaagccacctcttgtagcaacggttaaggccagtgccacattagataatttattcaagatatatggaacgatttgagaagtagaaatctctactgctaaaacttgaccttttttattgatgcatgcaataccattctcgtgattgtacggagctgcagtaaaaacagattctgctgtaattctattaacgaataaattggtaccggtttccaattcgtacaaatggatgaagccatacttggttaataggtaaattatgccgtatttctcagacacttgaacagcgatcgggaaatcattcgttgcatctggtggaaagaaaatatcggtagttttcttttgatattgagaaggcaatgaagcatcgtgatcaatctcgataattcttaattctccagcaccggtggtggcatttctgttaccagtaacgaaaacttgtaccggggtcgagccattaccctctagtaatatattcgtaaagatagcaacatgaccgtcgatagcttgggagatgttacgttgtttggagaataattgaattctaccggcaatacggccattttcttgtaagataccaacaactgcgaaccagtcaaggtttttgttagccacaaaattgataatttgggtattgttcaagttagcgtgtctcaaggtaagcaattgaggcttagcatttacgttaccatcaaagacgttcgaggtcagtatggatcttgcggtaacaaaacccaaagtggtttcactcaaccatctccaaaaaataacaggttcatctaaagtaaaagactttaacttgctcttagtttccaaattaaatatctgcacgatagtaccatttgctctaacggaaataaccatctgagatggatgcatgatagcagaatcaccgcccatattcttccttgtcacttcattgcctttggccaaatccacgattgcaacagagtttgtaccgtcctttgtttctctaacagtgacgaagtggtcactctcgaaagtagttgatctgaagtcaaggaattgaggggaaattcctaaggacgtcagatcgaccaattcggtaaattcaatgggtaggtcactcattggttagaactttcgtgataatttatttttatagttgaatatcttctttctctctcaactctgatccggattgtcgaggtttcaataagttactctgaacaactaatcaaaatatctccttatttctgtagattccttcagttccactttttgcttttcttaattctctttgtatttattcctagcgacgaaaaatgcgagatctcgaccaaaaaaagggggtagggtaataaaattaaccctattatttttgaactttaaaacctataatgtgctaatattttattatacacctcctttttttgtgtttaaaccctgacacattttaagccctatatttacggtattagttgattaaactccgaagcgaaaggaattcggtcattagcggctaatagccgttggggtaaatcacctacaagcaagtacacaagagaacgttggcgttgttaagtcaaagcactaatacattggggctttaagagtgttttataaaggtctgacctgtaaaaattatttaaacaacttgaacaggccttaaagttttcctcattccgctcatcatcactaatattgctctccgtttttgaatacacacttgacactaataagtatcacagaaaaaaagaaaatataataaattagtattgcgatatgacgagacgtactactattaatcccgattcggtggttctgaatcctcaaaaatttatccagaaagaaagggcggattccaaaatcaaagttgaccaagttaacacatttttagagtcatccccggagaggagaactctgacgcacgccttaatagaccaaatagtgaatgatcctatattgaagactgacacggactattacgatgctacaaaactgcaagagagagaaattactgccaaaaaaatagctaggcttgctagttatatggagcacgatatcaaaacagtgcgcaaacactttcgcaacactgacctgatgaaagagttgcaagcaaatgatccagacaaagcttcgcctttaacaaacaaagacctttttatattcgataagagattatcacttgtagcaaatattgatcctcaattgggtacgcgcgtgggtgtacacttggggctatttggtaattgtatcaagggcaatggtactgatgagcaaatccggtattggttgcaggagagaggtgccactttgatgaaaggtatatatggctgttttgcaatgactgagttaggacatggttccaatgttgcccagctgcagactagggctgtgtacgataagcaaaatgatacttttataattgatacacctgatctaactgccaccaaatggtggattggtggggctgcccattctgccacgcacgctgccgtgtacgccagattgatcgttgaaggtaaagactacggtgtaaaaacattcgttgttcctctgagagacccttcgactttccaactgttagctggtgtttccataggggatattggagcgaagatgggtcgtgacggtattgataatggctggatccagttcagaaacgtagttatccctagagaatttatgctaagtagatttaccaaagttgtccgttctccagatggttcagtcaccgtcaaaactgagccacaattggatcaaatttctggttatagtgcattgttaagtggtagagttaacatggtcatggattcatttaggtttggctccaaatttgctactattgctgtacgttacgcggttggtcgtcagcaattcgcacctagaaagggattgtctgaaacacaattaatcgactatccccttcaccaatatcgtgttttaccacaattgtgtgttccatatttggtgtcacctgtagcttttaagttaatggacaactattattccactttggacgagttatacaacgcttcctcatctgcagacaaagctgctctggttaccgtgagtaaaaagttgaagaatttatttattgatagcgccagcttgaaagccaccaatacttggttaattgctacactgattgatgagttgagacagacttgcggaggacatgggtattcacagtataacggatttggtaaaggctatgacgactgggtggttcagtgcacatgggagggtgataataatgttttatctttaacttcagcaaaatcaatattgaaaaaatttatcgattcagccacaaagggtagatttgacaacacactggatgtggactcattctcttacttaaaacctcagtacataggatctgtggtttctggagaaacaaagagtagtttaaaggagttgggtgattatactgaaatttggtctatcaccttaatcaaattattggcacatattggtactttagttgaaaaatcaagaagtattgatagcgtttctaagcttttagtcttagtatccaaatttcatgccttgcgctgcatgttgaaaacctattacgacaagttaaactctcgcgattcacatatttccgatgaaattacaaaggaatcaatgtggaatgtttataagttattttccttgtattttattgacaagcattccggagaattccaacaattcaagattttcactcctgatcagatctctaaagttgtgcagccacaactattggctcttttgccaattgtgaggaaagactgtataggtgtgacagactcctttgaattacctgacgcgatgttaaattctcctataggttactttgatggcgatatctatcacaattacttcaatgaagtttgccgcaataatccagtggaggcagatggggcagggaagccttcttatcatgcgctgttgagcagcatgctcggtagaggtttcgaatttgaccaaaagttaggtggtgcagctaatgcggaaattttatcgaaaataaacaagtgagtagaggtttcctgttttccttcgaaccctctgttttgcgacttttgtttcaattcaactagtgtcgccaagttttaacaaaaagttacaaaatcctagtgagaggccatcttttgtgcataacggtactctctatctatttacatatctaatactattcacataactatgacgaatcaatgacatgactacatttaccaatgtatagtagtaaaaaattgccatctcctagaatcgaaccagggtttcatcggccacaacgatgtgtactaaccactatactaagatggcaggtaattattgagtgtttactcaatatctcagaattatatacgtaacaaataataaatgtgctgtgttggcacttgttggaatgaagctctaaaatatcatgatgattgtgtggattctgatgtaattgttgggattccatttttaataaggcaatatgttggaacgagagtaattaatagtgacatgagttgctatggtaacaatctaatgcttacatcgtatattaatgtacacatcgtatacgtttaagtgtgattgcgcctattgcagaaggaatgttaaacgagaagctcagacaatactgaagctgtgttaaagacctattagctgaacatgatatggtaggtacatatatgaggaatatgagtcgtcacatcaatgtatagtaactaccggaatcactattatattggtcatgattaatatgaccaatcggcgtgtgttttatatacctctcttatttagtataagaagatcagtactcacttcttcattaatactaatttttaacctctaattatcaacacaataatattaggtatgtagatatactagaagttctcctccaggatttaggaatccataaaagggagtctgcaattctacacaattctataaatattatcatcatcgttttatatgttaatattcattgatcctattacattatcaatccttgcgtttcagcttccactaatttagatgactatttctcatcatttgcgtcatcttctaacaccgaatatcataatatactagtaacgtaaatactagttagtagatgatagttgatttttattccaacagtttatcaactagtagtcacactaccaatatattatcatatacggtgttagaagatgacataaggtatgagaagctttcatcgaaggtagaggaagcagaaatacaaggatttataatgtaatagggtaatggaccatataagggaggagaaatgatggtgatattaatatgcagaaatatcgattccattttttcaaaaaaatagtgccaaactattaagaagtagcgaaacagcaaaggcatatttccacatttcgcttttagcaatatacataactatggtggcaagataccatgcaactaataactttgccgcaatgacacctctatttctacttgttgtcgttttacctcttacttgtttgaacattgctgttctaagacctaacaataatagtcctaatacaaacagagggcatgctgttataagtataaaatgtttgctgtaactaatggtgggggaagattgcaaaaaacgaaggatatcagttccattcatttccagggatttgtgttgatatgtggggctatgaatgcgttgaagttttcaacttctgtgaaggagttaaaacaaccactaaacaatctcgttcaaaagctctaattacttgtatattattttatacgtttatgtctatttcaatgcaattacgtgaaaaataaaagaacgctaccataaaaatgttaaaaactggttaaaaatgtcaaaaaatggtccgaaaactgaaaaaatattcgtgatacagtttgcataaaaaaaaactattgtgcgcgattaatataacctactagacttaaatgacgacactttaatatgaagttcagtagtgtgaattaaataaaacagtcagttcttgatggattgtaccctttaaagaatttatctttatgtcgctgttactacgaaaagcgtgtgcgaggtattataactatttttctgtattttttatatatttttatttgccaagttaaaaatcagtcatctcaaaagattcatcgatttcagtgttcggaaggctagtatacttcttctttttcttagttttcaatttagatcctgctttgttagaagtgctacttatgggtgctccgccttctaactgctcatcttgttctaaatcatcttctgccccgagtccgctttccagatcatctgcccatgaaactgtcttattgggactgtcatgttgtctattatttggatcaactaaaattgtgtgacgcgcttttctcctcactcttctatcgtacgcataaactcctaaaaccactatcaaaaatgtaacaatggtaactactaccgctttgtgtttatacatagaaatctcttctgcaaattcttctacctcttcctcctcttgttcatattctgaagatttatgtctactatcctcgaggccttgattactttgtttttcattattatcgtcttcatcatcgtcgtcgtcgtcgtcgtcatcgtcgtcatcgtcatcatcgtcgtcgccctcggagttgtgatcgtcttcatcatcgtcatcattgtcgttatcatcatcgccatctttatctttattgccttctttttcctttccttcctcattctgcgcttcctgttcttcctcttcgaggttttcttttggcttatcaccgctttcagtggtagcatcttgatcactatcgtcgtcagtagtaatcataacatttttcccattgttgtcaatgatcataacatcgttcgagtaaatatcgacaatgcctctactcactaaacttttatcgaagggtaccatgtgagaagcattataaacgctaacaaacgtcaaatttctatcatacttcacgtatccgctaaattcttcgctgtcgtctgtactcttcgatttatggatccaatcgaacgaaacagcatcgtcgctaaatccctttattccaccccattttagattgtctatagtatctaatacgcccttgttattacaaatcaagtctttgtcaccattgaacaaaacaatctctattccactttcaagtagaccaggtaataaatggatagatggctttgaaataggattagacaatttagttccaacgctattagtgcattccttccaatgatcaattttatcagaatcaagatgcaacgaatcaataacaccaggtgtgctgaagaatttactgacaaaggaaacatctttcggccaattcataccacaagatggataactatcttttaaattgaagttatacatgttcaagcaatccgctgttcccttttgcgaagattccctggtataagacaatagaaggtttaaaatattctcacattcctgatacgaaaaatgggctgcctcatctgtactggccgagtttatcagattctggcaattctcgtgtgcgttcgttaagtgtttgaaattggggttgctttcatcaatcagtttcttctccatagcaaacggaaggtacgatagggactgtgtattggggtcaatccaaccgttaccaatcaatagcgccttcaagtcgtatgtatccccgtcgatctttgaaaatttgttatggttcaaaattgcattggcaaagaatggtatgtattggccagcgtaactttcacccgatagtatgattttcctagtgaggtcttctggaaaaatcttgaaatagttctccagaaaatccataaaatgcttggtcacatcttctaggtcttcgtcaaatttgtttttgtcgattttaccttcgtctttattttgttcgacagaaaacccagtaccagtaggttggtcgataaataaaagatcgcctttggatatccaggacccttcatttagataaagtttaccgtctgaattcaccctaaaagggccagattcgaccaaggcaccatccatggaagagcaaccgggtccaccatttaaccatataattaagggacggtcgacattgccattagagtcgttattggtaaacttccaaaaaaagtactccaagtcagagctatcctgttcatccgcatcttcggaacgtaaaggaatatggccagcatgcatctgtggaatatttgaagggtctggcacttcagataaccctggcaacagctcatatgccactttgtactcctcagatgacggaagggatactgagatccttattaaagcagacatggctagccacgttccgagccacctattgtaaaacatctattcaggtctttatctctacggtattctatagccaaggtactctttaaccaaagtatgcttcagcaagctttttcaaatagatgggagttgaagacaatgataagaaatcgcttttcttaatgtttactatattatcaaaatattccacttttttttctttttccacattgtttttcggttccgggctgcagtaagcaaatataaatgttggtgacaaaacttgaaagttatagccaaaaagctcgcaattcctcacctaacaaaatgatcctgttggaataaaaatcaactatcgtctataaaatagtagtcacactaccagtatattatcatatacggtgttagacgatgacataaggtatgagaaactttcatccaagttagaggaagcagaaatacaaggatttataatgtaataggataatgaaacatataaaacggaatgaggaataatcgtaataatattatgtagaaatatcgcttcccctttgaggattcctctaccctcgaggagaacttttagtatattctgtatatgtagagaatgtggattttgnnnnnnnnnnnnnnnnnnnnnnnnnnnnnnnnnnnnaacagtatatgataatatactagtaacgtaaatactagttagtagatgatagttgatttttattccaacagtatacataatattgtagccttgatcaacaatggaatgcctacaatcatctcaaaattcaccaatctctcagctcttatttaagctttgttgagacgagagttagttatccgacaatactatacaagacattaacatcatttttcgtgctgttagggtggtgtcttttcatttgttgcaataaatgataagtagtttaccgtccattaacatgtgcattaaataatagcattatgtgaacataatgtatatttaactaaaactattattgaagaaatccgaagaactcatccttgttagctcagttggtagagcgttcggcttttaagcgcatttgcttaagcaaggataccgaaatgtcaggggttcgagccccctatgaggagttcttttttatttttttcccggttcatacactatttttccaagattaaacatgactcatatacaccatccaaaaatctcttaattaacctataaccattgttctccttcacctcattcaagaatctggcttctgaattgccattgatagaagaacagtactaaattgcgccggaataatgaagaacatccgggttaccttagatgtctttttttcctttttttatcacatttttcactctgcactttttcactttctcgaggtccaatctatgactaatattaagcgcatttaatttgaagatatgtgtatcgcaatcttttttcttatcttgtagaccctcctatacacatctctagactatatatttggtttggttatatcttcaagaacttatttctttttcttatttttccattccactaagttaaaccctgcagttgatacagacattgaataggacaaccgatcgttactatcatgactttacctgaatcaagagacttttcttacttgttttcggatgaaaccaatgctcgtaaaccatccccattgaaaacctgcatccatcttttccaagatcctaacattatctttttgggtggtggcctgccattaaaagattatttcccatgggataatctatctgtagattcacccaagcctccttttccccagggtattggagctccaattgacgagcagaattgcataaaatacaccgtcaacaaagattacgctgataaaagtgccaatccttccaacgatattcctttgtcaagagctttgcaatacgggttcagcgctggtcaacctgaactgttaaacttcattagagatcataccaagattatccacgatttgaagtataaggattgggacgttttagccactgcaggtaacacaaatgcctgggaatctactttaagagtcttttgtaaccgaggtgatgtcatcttagttgaggcacattctttttcctcttcattggcttctgcagaggctcaaggtgtcattaccttccccgtgccaattgacgctgatggtatcattcctgaaaaattagctaaagtcatggaaaactggacacctggtgctcctaaaccaaagttgttatacactattccaacgggccaaaatccaactggtacttccattgcagaccatagaaaggaggcaatttacaagatcgctcaaaagtacgacttcctaattgtggaagatgaaccttattatttcttacaaatgaatccctacatcaaagacttgaaggaaagagagaaggcacaaagttctccaaagcaggaccatgacgaatttttgaagtctttggcaaacactttcctttccttggatacagaaggccgtgttattagaatggattccttttcaaaagttttggccccagggacaagattgggttggattactggttcatccaaaatcttgaagccttacttgagtttgcatgaaatgacgattcaagccccagcaggttttacacaagttttggtcaacgctacgctatccaggtggggtcaaaagggttacttggactggttgcttggcctgcgtcatgaatacactttgaaacgtgactgtgccatcgatgccctttacaagtatctaccacaatctgatgctttcgtgatcaatcctccaattgcaggtatgtttttcaccgtgaacattgacgcatctgtccaccctgagtttaaaacaaaatacaactcagacccttaccagctagaacagagtctttaccacaaagtggttgaacgcggtgttttagtggttcccggttcttggttcaagagtgagggtgagacggaacctcctcaacccgctgaatctaaagaagtcagtaatccaaacataattttcttcagaggtacctatgcagctgtctctcctgagaaactgactgaaggtctgaagagattaggtgatactttatacgaagaatttggtatttccaaatagagaggtaaatacattggaagaatatatataaggtgaaaaaaggacgtccgtatttttgtattgcttaagtttcgaagtattttttctttttgtaaaagactgcaagtggaagccaaaatataatattttgttttttcattaagagtacaactttatacaacaattataacttgatttgagagccaagttatgtaagatatttttctcccacaaagagaaatgcacacgataggaatttacaacgtgaatgatacttgaaacgtgatatgaaaatccgcaagagtgcactgaattagctggaatcctgtggttccaattgatccaaaacctcacaatttggatgaataacataaacagttttattattttcattttcctcattctcaagatctcttaaattgtgtctggtaccatgaatctccattaaaatcctatctttgaccaacctttttatgactttaaacgctaatcttctctcttcccaatattctgctaacgaacccaaatcattttccttctgtaataaataccaatcaactatatccacagctgttagttcttctgcaccctctctatctacttcagcaatctttctaacgatcatgttcatcatggacacatatttatcatacgtcaccgttgttttcttcttctcgcttgtacctggacgagctgtagcttcgctttgtccttcttctatatctgctggtggttcactcgtaattacacctgacccagtcccatcatcattgtttccagaagcggcgtgactttgactctctatgttatcaaattcttcatccatttccacatcatccacatcaacacgaataatactttgccttaaaagatcgtaagcttctgcaatgaatgatggagtaatttcatcgacacaattagccctcgcaatagcttctgataatctaatcatactttcaagttgcctaactgtgattctataacttgatctactaaatccctgggcatcatcctttctcagttccttatacttctcgactaaataggaacgggcttctttcgttaatattggtttaaaagtacgtgcatatttgatataacgacgtagttgttctgcactaaatggcggctcaatggcttcgtctcttttcatgtgtaagtcaacgatatgagatgccaattcggtatcaattttttcgttacagtcatcaagaataacaaaaaataaatcaaatctggacatgatcggtgcggtcatatttaaattacccctcagtgatagtttcctattgtatcttccacctaccgggttggcagccgctagaattgatgttcttgcatttaaagtagcgtgaataccagctttagcaatagagatggtctgttgttccatagcttcatgaatggcaacttgatctgaaatatccattttatcaaattcatcgatacaacaaataccgttatcagcaagcattaaagcacctgcttcaattgtataatcacctccttcctcatctctcacaaccgcagctgttaaaccagcagccgacgaggccttaccggaagtgtaaactgatcttggtgcaaatcccactacgtattttaaaaattgagacttagaagtagaaggatcaccaacaacacagatgttgatatctcctcttaacttaataccttctacagtactcttatgaacaccaccgagcatctgaagcaagatacccttctttacggcttcatggccaaacacagctggagcaatagatctgaccaatttatcataaatatgttcatcctttaccatttccttcagctcatttatttcatctgaactcaaactgttcaagaatacttcttgatctctttcattatcttggtatacattattagcttgtaaattagcagccatctgtagttcagtttctcggttgttagaatttgcatcagggctacttgcaccaatgtttgatccaatactgataacatggcatgccagaaagctaatcttgtatgtcaaatcacgaacaccaagagagcgtaaaccagtaacaccactattcaaaccttcagtagtcttcgaaatacctctagtatctaatgttgaacttggcttcacacctggtagccccaattgtgtaacatcaggtactacaatttccacacccgtaaatttgcaacggtcacctggcttggctctttcgacactatcacctcgaagaatgacgtccagcgtacgcggcatggagcctgtaggtatttcgttagcattttcttgaattctgactttttgccaatcaagaaatctggatcttgtaacatttaatgtccaaaaggctctattttcacatgatgggttcgggcaaaatgtcggttcagtgtacttgaaggactgttctacgttatctacgatagcacggcacatatcacacgtaaagcttgccttgtataattctggacggacctcagatgttcttgtcactgtccctgatatactcaatagtgaaccaatcttttcagatcttatatcacgaattctgtgaactgttggtagattgaagaaactgatttgaaaaacacgttccgtctgttcaggtgacgtagaagttgttattgacctcgttgccatggcagatgtcccattccctggtgcggctgatgatccagaatctcttggtagactcgacccattcatatcatcgtcctgttgctcatcgtcatccgcttgaccttcgtcaccttcggatctcttcaatgagtcacttgtgtttaacaattcaggtgcatactttcttactactcttcttaaacccttttgtaaaaaaggcaaaaatctgtaatattgttctgagatagccatagctagagcaccattttctctcatggataaatgctgataatctatataaatggtgtttaggtcatatattttcataaattcaatttgagctctataaactttttcaacttcaccagtatcagtggattgaacggaaaagtcttccaaaaactgctcgaacgcttcacggactttttcaccagtaacgtcatcaactttcttaacgtgattcaaagctctacttttgaagcttctggcaggttcatttccctccatatcattagtcgcggaaccatcggtttgcaacctttgagaactaaactgagtggaatcgttaacaaaagggcctgtttgtgaattactgacatgcggttgagaagaacttgggaaatgtaacctagagcctatttgcgaatcgagtccgctactgcttccgaagccagcacctatcgacgatggtggcggagaggagttggaaggtctattactgcttggtgtgtcagctggaaaaggggatgacattggaaaaaaccagttttaacctttgataagtctatttttcctatccaccggtggcgaagtgtaagatactcgctgtaaatcacttaagaatgaaatattttgttattattgtagattaaagaaagaaaaaaaaaaagcttcaagaaaggcctattaggcgcttttcctaaaaaggaaatttaatagacgaacttagatgacaataccaaatagcgaaggaacggcaaaagaataggtacacaaatgttatgagaactggaatcaaaacgagctattgtttgtcgacgaatagtaatgttactagtatattatgtgcggtgataatatgatataaatcgcgaaaagggtaaacccagtaaaaactgaaatgcaagataaataacgtaatggggtgatgtatgatatcgtataaaacacaagaaaggataacagcactatcatgcaaaaattgcttatttctggtatattctggattccgaatgacacttcccttactggaaaatcgaattcaagtgaccatttaaatggtcacctatttctcaggatgaccgctaattcttctcatcagggtttcccaagttgttagcaaactgtattgatatctttttgcgggagtgaaaccaactattcagctcagtatcggattaatctctccacttaatgccacggagttcttccaaacattagtactggtgccagtatcagcaccacatcaacaggtgaactcaaaattacattagtcaggagcagtacacccgttaatcgtgggaatctctgtactgagggtcaattacgtatcgcggaactaggggtccactagtgtatgcgactgcgattcatataacactttaacgtcaaaaccttatatagtcctcatccgccttgggggccagcatattatatataaaaactcctgaaaaacacttacccagaagtacgataatgaatgacgcttatgtgatttatggttaacgcagtacccaagacaagtatgcggcgttaactcccaatcaaagaaaatataacggattctaatctgacgaactacggacagtaattggtatttttactcattagtgactttggtaatgccctatatttcactagaaggtgtcacagtgtcacaaattttacatcacaattccctttcgtaagatcaagaatatggctgactatagtggacatcttcttacaccgtatatagtaatatattactaatatgagcactagttgattcttgttccaacagtatattccaaacatgtgttaatcacgcgttgatacaatgtggctcggctacaaatcagttattaacatcgagagctatcattccctgaaatggggacgttttccaacgaattagccttgttggcgcaatcggtagcgcgtatgactcttaatcataaggttaggggttcgagccccctacagggctattcttttttgttctatatgaacagagctatttcccttctaagagtccaacgtaaaagtgctatggggaaaaacggacccagcatgtcctgtggtacttgtctctttcaagtttttcgtatgaatttcccattttttgattcgctacaacctgtaattgttttatggcgcgtcctggaccatatatatgtatatatttatttacatgtaattggcacagggaaaaacagtggaaggatcaaggtaaaaagtatgaaaccgagaattattcgcgacttcaagttatccaatcgtgtatgtaatcgtatgtaggcaaaagtaaatagatatgatctacattttcctgctttacttagactagagatgtgacctcaaagaatcttctcaagtagtatatctggaaaagagagtttgcaataacgacgcccaattggaagatggaccaccatttgacacgatcgttggtcgactctgcagtatttctatgcgtcctttctctaataacaatataactttgttcgtccttgacttccctggttaatttggacaactttctgacagcactatccaatgtattggtgtttgggtcgtccaaatccacatataccaccccatgaatgttgaaagtcacgtcttttgtctcgataccggtgttctcgttcaagaaacagtattggaaatgtcccttgtatggagcagacaatgtgatttcaccgtgcgacgtgtccctaaccgttttcaaaacttcatgtctttccggcccgtagatgataaagtcaccagtcagctggctactggattgagggtttctatcaccgaactggaacgaaatggagagctcgtcacccttactcaagtcttcgaagaagcatctacggccataagctggaagaaggacattatgggcagacgccgagaagaacaggaagcaagcaatgacaaacttagtagcaaatgaggccatccttatgcgtgtgtatttttgtgccgagggatactattaagattgcagtttcaccaagtatagctttttattttattataagtttcgtgtcaaaatgtttaagcgacccgatctctcaggctgttttgcacgacttttctgactttcctcgcgtcttttttcatgaaaattggattacccggagtgatgattttctcacagtgatttttcgtccccttttacaatagtaaatgaagctgttttagcaatatttgtagaaagaaatgtcacaagagggcaggcaaaatgtcatacggaagagaagacactacgattgagcccgacttcatagaaccagatgcacctttggctgcttccgggggtgttgctgacaacataggcggaactatgcagaattcaggcagcagaggtacgctcgacgagactgtgctgcaaacactaaagcgagatgtggtggagattaattccagactgaaacaagtggtatacccgcatttcccctcattttttagcccctctgatgacgggataggggcggctgataacgacatttcagccaattgcgacctgtgggcgccccttgcgtttatcatattgtattctctatttgtatcgcatgcgcggtcgctgttctcgagcctatttgtgtctagttggttcattttgctggtgatggcattgcatctgagactcaccaagccacaccagagggtgtcgctgatttcgtacatctccatttccgggtattgcttattcccacaagtgctgaatgccttagtctcgcagatactacttccattggcctaccatattggaaagcaaaatcgctggattgtgagggtcctgtcgctcgtgaaactggtggtcatggcgctgtgcctgatgtggtctgtggccgctgtttcgtgggttaccaagagcaagaccattatcgagatataccctctggcactctgtctttttggcatggcctggttgtcaactattttataacactagttacatatgtataaaactcaatatcatggacatagaattgcctatctcgcgagccacggcagaaagttctgaaaaaaaaaaagaggacgctcacaggggctggtgcgtggctaaggcagactccgtggagtgtaagagaagttcaaagcaaggttaggctttctgatgaattggtagcgcagagtctggcaaagtctatttcaagttcacagcgtccatttaccacaattgttcgagaactcttctccttcctgtgcctatagccacacttgcaaacattacatggtgaaggcgctttagagacttttctgttttactatatatataagataacatagcgcgcgtgcaaaccaaaggacaagtgacaatctgcacctgctttagcgtagtatgcctttattacaaccatccgcttgcttctgctaccctttgaagcttccgccattaccactggcttccgattccaacgagtttgatgaatgcgccaggaaaaggttaacgctggactatagaacaggttcagcggtgacgctaacaaggtccaatatatttgtacatggtggtctaaccatcccgttgaacctgccagttgtaaattctatgcaattgcaaaaggagcttatcctcttttttgcaaaggaaaaaaacaacggtagttcttttaggaatttaaacgagtggataagtaaggagacgtttttcttagacttgatgtctagaacctggtacagagtcaagacttcctttgaccaaaggacagaggaattattaaaggcagagagctctagcgccaaagcagataatgacacaaacgagattaaaacggacattaagaaaggcaaatcccttgaatctccgctcaaggagagactattccattccttatgctatttagatggctgtttatatatatttggtggtctcacagtgtctcctcagagcggatatgagttgattgctaccaatgagttatggaaactggatttaaacacgaagaagtggtcgcttttgagtgatgaccctcagatagcgagaaggttcaaccataccatgcatgtaaagaacgaaaataacgataatagagacacgaaattaataattgtcggaggtcttaataacatggatcagccggtcaagaaaatagacatctataacatctcacagaattgctggcaatccgaaaccatacctaaacaaccgatggagatcactacaaatgtcaatggcataccattagcattatcaaaggatcagaatttttcgattttagttgaaaataatgaggccaacgttccaacgctggcattctatatgagaagtgatcaaatagacgaatatctcggaaagtatccatcaaagataaaggagaattcgcctatagtggcgttgccgctattgtctgaatcgcaaggtattagaatgccctcaaacccggcattaccgaaaaaactattgaatgttccgtatgagctattagcgccgacaggtgactattttggatttaatatcataatcggtgggtttcatccaaattaccaatcctctaactttcattgttttatatacgatattaactccggaaagtggtcacgagtcgctaccgcctgccctgactgcgatatcaataaacatcgattctggagggtatttgtttggaaatcgcatcatcagacgattttgttgggtaccaagactgatgattattattcacccagtgtacaaagattcgaccatctttccacttttggattaccgctggtaaatatttttaacaagacgatccaactaccccatcacaggatctcagcttcgtctttaccaatacccatagaaaattttgcaaagcataaggatactcctttaaaaaaggtgagcttcacttcatcagctacctcccaatttgaaaactacattagatatatagctccgcccttggaaatgtcttctatccaatctatgtttccaccgtatgccatggttctaggtaaagacgctttagagatttacgggaagcctctttctgattttgaatttattactagtgaaggtgactctattggtataccatgctatttgctgaggaaaagatggggccgttatttcgacatgcttttatcccagagttatacaaaagtttgtgctgattatgaaactactggtacgcaatctacactaataaaattttcaccacattcatctagaaacagttctaaagctgtgaggcaagaaggtagactctcttcatcgggttcactggacaattatttcgaaaaaaacttcccaatatttgcgagaacaagtgtttccgaggcccagaatacacaacctcaggtagcgaatgctgatgcgaaagctccaaatacacctagtacgtcagatgaaccaagctcttcctcctcttccgatttatactccactcctcattaccaacgtaataatgatgaagaggatgacgaggacccggtttccccgaagcctgtatcaaaatcaaacagtatctacagacccatcagaaagacagaaagttcatcaacaacgagttcttcaaacggtatgattttcagagtacctttcaaggagaaagcggctgtaacgtcaaacactgaagccctcttggagtcaaacctttcacttcaagaattgagccgaagaagatcgtcacttatgagcatcccgtctggtgaacttctaaggtcctctatatctgaagcggaacatcaacgtcgtgcatctcatccgctcacttcatcaccgctctttgaagatagtggaaccccttgcggcaaacaactgcaacaactgcaacaacatactatacaaaatcctcataaccatttgtcgccccggaggttttcaagaagtgcaagaagttcaatttcctacgtgagttcttcttccgacagacgtggaaattcaatttctagcaggagcacaagcgatagctttggaactccaccagttttgggcgttttgaatgtaccattacctcctcaaacaagagaacctaatgaaccacctccaccatgtcctgcaatgagtacctgctcaaatacaaggcgaagcaacaccttaacggattatatgcattctaacaaggctagcccgttttcttctcgtagatcgtcgcatatcggtagacgttctagtacaccggaaacggaaaacgcattctctgcaacaccaagagcatccttagatggtcaaatgttaggaaaatctttgaaggaaggttctacatcacagtacacacagccaaggatgaactctttcccaaaggctaatgaaaccatacaaacacccacatcatcaaacaatgaatggagccgtcaatccgttacttcaaatacagatagttttgacagtttgcaatctaattttgcgttagagttggaaccacttttaacaccgaggtcactttatatgccttggccaacctccacagttcgagcatttgcggaatttttttacactgggcaagtaaacagtaaatggcttttggcaccagttgcccttgatttattagtaatggctaagatttatgaaataccattactgtataaattgatccttgaagttttatattcgattctggctaaaaaagaagaaagtttatccttaatatgtacttcgttaatggagacctttcgcaccaaaactctgaactcctataaaggtgatgaagaaaaaacaaatacttatttgacttcaaacgataactatcaggaactgttgaaattaaaagtgtcgctggagaatatcgacaatgggtattatgacccagatttgttacgcaaacagtcaagagcacagtcttcaagcacacaagaaagcagtggtagtgcaaacggcgaaaaaactgcaactggagctggctccctggagacttcttcaaccaatgtccctacagtatttgctggcggtcccagagatagccacaattcagtaggctccattggttttccaaatagtatgaatatacaaggctcaagaagatcgacatcaggattttctccacgcgttaagatgaaatcgagcttaagcaaggaaatagatcccaaaactttttatgaagagtacgaaccaaaagagggcaaaagttttgatgataacgatgatcaacaaaccaacattggaagttttaaccttcatttgtttgatatgaattatggttccatcagcagcagtagcactaacagcattagtagcagtgatttagaagagaaagaagaacaagggcaacttcaagatttattggaaatagaaagagaagattctgctgagatcttagacgcaagattcagaaacaaagaagatgataaggtgacgaaggatatatcaaaagacaagaaacgcaattacttaccgcatgaaaaaaataacttgaaagccaaggaaggtaaggaaactagagacgtaagggaggaggaggaagaattcgattttggtttgggaatgctttcgctcaataaaataaaaagagaagccaagcatgtcgataaggtggacgattctgtagaccctttatttaaatcatctgctttccctcaaagtcccattcgagcatacgggtctaccacaagaagtagttcggcttctggaaagccattcagggacaatcgttcatttaatgcattttctgttttgacattagaaaatatggcgtctgcaaatgccctacctcccgttgattatgtcataaaatcaatatacagaaccactgtgttagtgaacgatatcagactaatggttcgttgcatggattgcattgaattatctaaaaatttacgagcgctcaagaaaaaaactatggaagatatttcgaaattgaaaggcatctgtaaaccgtcaccatagaccgctacctcccaggatagttactcgcacatataaagttcttaataatccaagaatatgctgctatacatctcaaaacggattgcttccatatgggcgccacttttctgtttctttgctatcaaaacagttggcaccaaaaagctactcgttgcaaaggtttattgcttatgaaatattgctttgtgaacaaattcaaccgaaattacccggtgaatatgactatgtaagttattagtataggttgcatttgctctattcgttgataagacaacatcttgtatcatactagtttccgcacactaatatttcgtctactattgactttctgataaggttatctggttcctgtatttgcagtttatcgaagcgggcagaccaggtcagctcaggataattcaaattcagataatgaggcacagactaatcataacacgaaaattgaatacatcccacgatatagcataaccaaatgtcggaacataactagcaatacaatttttacatcgggccgaatccgtcggagagtgataagacggagttaaaatatctctcaaaaccatggaacaacaatatgtgtacatatataaagcttttgagtgaaaagatttctttccactatttactgtcaattttattcaacacgaaagggaattaagtgcacataaatacttcatttcttgataaggaagtataatattgctcctaagaagagtttgaaatgagcgatgttctatctcaatataaagggtgctcagtcagagatttacccacacccaatttcgttattaatgaagaaaaatttgataagaattgtacgacaatgttgaacaacgttgaaaagctcagccaggaatgtggcgtaccaatcaaatttcgtgcacacgtaaaaacgcataagacagcaaagggaactttgaaacaattgggccacggacttccattggctaaacgcactacaagagccatattagtatcaactttgaaagaagcagaagaacttcttaattatcaagatagacaatgttcggattatattgacgatataacatatagtttaccctgttgcgttccagagtttattcctcttttgagcaatttgtcaagaagggtgaataattttcaggtttttgttgataacattgaacacttggagaatttaaagaatttcggtaggcctgcttccggcaagaaatggtcggtttttatcaaagttgatatggggactaagagggcaggtcttgctttcgactctccagaatttttgagtcttttaaaaaaactgacttcctcagaaattaaagaagtaattgagccatatgggttttatgctcatgccggacacagctactcttcaacctcgatcaacgacactcagaatcttttgatggaagaagtgaaagcagtcaattctgccgcaaaagttttgtgctctgtggatcctcagtttgatccttctaaattaacactttctgtgggcgctactccgacttccaattccttgaaactcgataataaaagtacccttgttaaattcgttactactcaattagttagtacgcttgaaatccactgtggtaattactgcatgtatgacctgcaacaggtggcaacaggctgtgtccaagatcacgaattgtctggttttgtattaggaacagtactatcatcttacccttctagaggtgaattgttgagtaatacaggagtgatgtgtctaacgcgagaagcatcctcaataaaagggtttggaatatgtgccgatttggaacatgtgttaaaatccgagagcttcagtagggaatggtatgtagcaagggtctctcaagaacacgggatactgaggccaataagaaactggaacgaaactactgcgttaaaattaggcagcaaaattgccgtccttcctcaacacgcttgtatcacaatgggacaatttccatattatttcgtggtaaacagccaaggcattgtcaacgatgtttggttaccttttcagaaatggtaagctctcttttgtcgttggttatcactctcatcaaagcatctctgtgtctatgtaattgtgtatctatttataaacagtaactaagagtaaggttgtacacaggttggtctaaacatcctcttgttaagcttccgcattacctgcgagctggtaattgtaatacagatttatttgttgatataatgctatgaaatttcaactaccgtcattgagtttctcaataaagtcgttaagtacgactgaaaaatttgaatagtttaaaccttcgaaaagatctttgagttgtacttattaaacctgaagtagatcgttaagacaagcaaagctctgactgacaccaataactcctacagtgatgacagctatcttaaactgggaagatatatcccctgttttagagaaaggcacccgcgaatcacacgtgtctaaaagagttccctttttgcaagatatatcacaattagttcgtcaagaaacattggaaaaacctcaattatctgaaattgctttcgtgttattgaataccttcccgatttacgaagacaataggtctaaaagtttggtaacttcagtattgcttgacatcttaaatctagagccatgtctcctagaaaactttatccgattcatttccgacgtggtcatcagtaatccggctaccaaagcagtcgctgattaccttaatttgttagattggattaattctttcttgatttttgtgtcgcataattctaatttatttgaagagtacattccaaaattgttggtcgtccattcttacgcaacgttcggtgtggaaactattcttgacaatcaagaagaaggcaagaaatcccaagataagcagaaccagcatagaaagagaattcgttattgcattttccaagcaacggtcaaagcattccttaagtgcttgaaggataatgacgacagtatttccttcatgaagatttcaattaaaactgtactggagagctactctaagctgaagataaccagtgttggagtagttatgataatgggtgcactaactcaggctgcacttcagttattatcgaggcaaccagctctgcactccgttttaaaggaaaattctgcagagaaatattgcgaatatttgggcaaagaagtgtttttaggcaaaaacccaccatcttccttttgcttagagattggtttgaagccatttttaaaagaatttgtttcacaagagttattcattaagtttttcatccctaatattgaaaaagcagttttgagatctcctgaggttggtttttcaattttatctgagttatatgctggtgtttcttctgaaaaagtaaatctcttaaatgcctttacttcctcgaaactgattaatcaatacttctcgtcatttaaaagctcaaaagaggtagttagatccgtctcgcttcagtctatgataatcttattgagaaaaatttccaatactgacactaccttggaagatttgaccaagcttattgacgaaatatttaagaacatcaaatcgaacttaaatgcagattacaaatcacttatttccaaaattctcatagaaatacccttaacgcactatgaggtttcagaaaaaacctgtaaagggctgtccccatatattggtaaagaaggtaatgaagcagccttgactctaatgcttaacgctttttttgttcattattttagtctgggcaaacctattgaagacttggataaaattatatcagctggttttgcagataaaaaacctgctttgaaaaaatgctggtttgccgcatttttgaacaattccaatgctgcctctgaagaggtgattttaaactttatagacggttgtttggaatttgtgaaagactccatcatacattaccagactcacgggcatgcatgtattctagcatcaattgaatttacaaacaaaattttggcattggacaatactgagctaaatgatcgtgttatgcagctcatagaaacccttcctgaaaattcttcgataggtgatgctatcttaactgctgctttatcaacagagctatccatcgaaaaccgtattcatgctgttaatttactacaagaattgttctacaagaaacccgaatttattgggtttagtgtgattgatgcaattgaaaggagaatgcgtgtccaagaattaatacctcaacaaaatacatcctttaaatatgtcacttctgtactactggctattacgtctgagttacctgacaaggaagcctcgataaaggtattaatcaatgctctggtcatagcgcaatggaatattttcaacattaagaatggctgggctggtttagttttacgtgcaaggcttgatccagctgaagttgtcaaagaacatgctagcgttatcatggagaagattcttgaaatcacaggtagttgtgaatggatagatacaatttatggtgcatgcggtttgcaagcagctgcctatgcagcatttattcaacctactgagttcacaccgatcctttgtaagactatcgaagcagatttaaccgcggatgatttctcacgtttatctgaagaggacttcgaaatttttgcaggagaggaaggtgttctggtggttgacgtcctggaagaaagcatgaataagaaactttccaataaaaattctaaagagtacgaaactctaatgtgggaacaaaaaataaggaaggagcaagccaaaaagaatgtgaaaaaactttcaaaagaggaacaagagctcgttaatgaacagttagcgaaagaatctgcggttagatcacacgtttcggaaatttccactcgtttaaagcgtggtattagattggtatctgaactttccaaagctgcttgcttagtccaaaatggcatcgctatttggttccccttggcagtcacaaagcttttgtacctatgctcggaaccaaatatttcaaagctaacagaggatgtaaatattgtgttcttgcagctttctcaaaatgtctccgagagattaggtaatatcagacttttcttaggtttggcgactttgcgtgtgcacaatgctaatggcatctcgcaagattatttacaagaaccactggttgaattacttacaagagttctttttaggatcaagttcgtctccaatcaagcagcgatagatcccattagtttgacatatattttgccattgttgattaatgttttagaaaagggtaaggcgattgcattaaagaatgcggacaagcctgttgttaaggctgagtttgttgaagaagatgaagaagaagaacatttgttactggccatggaaattatttctgtacacgctgaagcttttgaggatccttccattccgagaatttccattgttgaagtgttactatctcttctatctttaccctcaaaagcgaagattgctaaagattgttttaacgctctgtgccaaagcatatctgttgcaccaaatcaagaagaccttgatatgatactatcaaatttactatcaccaaatcaatttgttcgttcaacaatattagaaactcttgataacgaattcgaattggaaccttttatgaaatattcaccggaagttttcatttgcagatttgattcggacccttccaaccgtgagattgcagatttcatttgggaattcaacaaatttgtagtcaacgatgaattactaaaaagcttattcccactattcaatcaggatgatagtggcttgagattatttgcggcaaacgcgtacgcatttggtgcggtaagtctgtttacctctgaagagaactcgtcgaaagattacttaaatgatttgctgaacttttataaagaaagggcaaagccattggagccaattcttgatcaatttggtttggttcttgtttctgcaagtgaacaaaaagatccatggcaaggaagaagtaccgttgctattacattaaaaatcatggctaaggctttttctgcagaggatgatactgtcgttaacattataaaatttttggtcgatgatgggggtctagtagacagagagccaattgttcgtcaagaaatgaaagaggctggtgttgaattaattacgttacatggctcacaaaactcgaaggatttaattcctatatttgaagaagcattaagctccagtacggacagtgccttaaaagagaacgttattattttgtatggtacattagcaagacatttacagcaaagtgatgcaaggattcacacgatcattgaaagattgctttcaactttagatactccttctgctgatattcaacaggctgtgtcggcttgtatagcaccactagttttccagttcaaacaaaaagttggtgattacttgggtatcctaatggagaaactgctgaatccaactgttgcttcttctatgcggaaaggtgccgcttggggtatcgctggtttagtgaaaggttacggtatctcggctctctcggagtttgacattattcgcaacctcatcgaagctgcagaagataaaaaggagccaaaaagacgtgaatctgttggcttctgctttcagtatttgtctgaatctctagggaagttttttgaaccatatgtgatagaaattcttccaaatattttaaagaatttaggggatgctgttcctgaagttagagatgcaactgctcgtgccactaaggctataatggcgcatactacaggttacggtgttaaaaagttaattccagttgctgtttctaatttggatgaaattgcttggagaactaagaggggctctgttcaattgttgggtaatatggcttatttagatcctactcaattgtcagcttctttatccaccattgtcccagaaattgttggtgtattgaacgactctcacaaagaggtgcgtaaggccgctgatgaatccttgaaaagattcggtgaagttatcagaaatccggaaattcagaaattggtacccgtacttttgcaagctatcggtgatccaacaaaatacactgaagaggccttggattcattaattcaaacacaatttgtccattatattgatggtccttcactagcactaatcattcatattattcatcgtggtatgcatgatagatctgccaacattaagaggaaagcatgtaagatcgtgggcaatatggccattttggttgacaccaaagatctcatcccatatttacaacagctgatagatgaagtggagattgctatggtggatccagttccaaatactagagccacagcagcacgtgcattgggtgctttggtagaaaggttaggtgaagagcaatttccagatttgattcctcgtctactagataccttaagtgacgaatccaaatctggtgatcgtctcggttctgctcaagctctagctgaagttattagtggcttgggcttgaccaagttggatgagatgttaccaaccattttagctggtgtaaccaattttcgtgcttatatcagggaaggattcatgcctttgctgcttttcctccccgtttgttttggatcacaatttgctccatacattaatcagattattcagcctattctttccggattggccgataatgatgaaaatattcgcgatactgctttgaaggctggtaaattgattgtcaaaaactacgctacaaaggccgttgatttgttgttgcctgaattagaaaggggtatgttcgatgaaaatgacagaattcgcttatcttctgttcaattaaccggagaactgttgttccaagttactggtatttcctccaggaacgaattttctgaggaagatggtgatcataatggtgaattctctggtaaattggtcgatgtacttggccaagaccgtcgtgatagaattttggccgcattatttgtatgcaggaacgacacttctggtatcgtacgtgctacgacggttgacatttggaaggcattggttccaaatactccaagagctgtgaaagagatccttccaacattgactggtatgatagtcactcacttggcttcatcatccaatgtattacgcaacattgctgctcagaccttaggtgatcttgtccgtcgtgtaggtggtaatgctttgtcccaactgttaccaagtttggaggaatctttgatagaaacatcaaactcagattcgagacaaggtgtttgtattgctctttacgagttaattgaatcggcttctacggaaacgatatcacagttccaatctactatcgttaacattattcgtactgcattaattgatgagtcggctactgtcagagaagcggctgcattatcttttgatgtattccaagatgtggtaggaaaaactgctgttgatgaagttttaccatatttgttgcatatgcttgaatcttctgataattctgactttgctttgttaggtttacaagaaattatgtcgaagaagtccgacgtaatcttcccaattttaattccaaccctattggcccctccaatagacgccttcagggcttctgctttaggttctttggcagaagttgctggctcagccttatacaagcgtttatcaattataatcaacgcactagtagatgcaatcataggtacttctgaagatgaatcgaccaagggtgcattagaacttgcattagacagggtattcttatctgtgaatgatgacgaaggtcttcacccattacttcaacagattatgtcactactaaagagtgataatatagagaaacgcatagctgttttagaacgtttgccaaatttcttcgataagactgttcttgattttgatgtctatattccgaactttgtctctcacgcaattttatcattagatgatgaagatcaaagggttgttaatggtaatttcaatgctctgtctactttgttgaagaaggttgataagcccaccttagaaaaattagttaagcctgctaaacagtcattggcattaacaggcaggcaaggccaagatgtcgctgcatttaagcttccaagaggccctaactgtattttgcctattttcttgcatggtttgatgtatggttcgaatgatgaaagggaagaatctgcattagccattgctgacgttgtttcgaagacccctgccgctaacttgaagccatttgtgagcgtaattactggtccattaattcgtgtcgtgggtgaaagatttagtagtgatatcaaagcagcaattttatttgcacttaatgtgctattcattaagattccaatgttcttgaggccttttatccctcaattacaaagaacatttgttaaatccttgtctgacgctaccaatgaaacgttacgtctccgcgccgcaaaggctcttggtgccctgattgaacatcagcctcgtgttgaccctctagtcattgaactggtgacaggtgccaagcaagccacagatgaaggtgtcaagactgcgatgcttaaagctttactggaagttattatgaaggctggttccaaattaaacgaaaattctaagacaaacattgtcaatttagttgaggaagaaatgttgggtagcaatgacaaattggcagttgcttacgctaaattaatcggatcgttatcagagattttgtcgaacgacgaagcccacaagatattacaagacaaggttttgaatgcagatttagatggagaaaccggtaagtttgctattctgactttgaattcctttttgaaagatgcacctacacatatattcaatacgggcttgatagacgaatttgtaagttacattttgaatgcaatccgttcccctgatgtttacttcggagaaaatggtaccattgctgctggtaaattacttttattagaaggagaaaagaggtctccatttgttaaaaaggatgctgcagaaccattcaaaattggcgatgaaaacattaatctgttaattaatgagttgagcaaagctgtcttacaaccagccagtaattctacggatgtaagaaggttggccttggtggttataagaacactagccagattcaaatttgacgagtgcattaaacaattcttcgatgtagtaggaccatctgtattttcttgcttgcgtgatcctgttatcccaattaagctcgcagcagaaaaagcatatttagctttgttcaaattggttgaagaagatgacatgcatactttcaacgagtggtttgctgaaatttcagatcgcggtagcagcatcgaaactgtcacaggtactacaatccaattacggtctgttggggactataccaagagggttggtaaaaggttagcaaatgtcgaaagagaaaggattgctgccggaggagacgcggaaacaatgtttagtgacagatttgaagatgaaagagaaatatgggctgtcggaggtgttgaattaaccactgatgtttgaagaaaattcaatgtggtaacctcgttactttttgtatttgatatattattctcgttatataatacataccacataatgatatggaagacaaagatattttgaagtcttccgctgtgcataagggttatttatatatctattgatcccagcattgtagctaataagggcttgataattattcgtacccggattcataattgtcaactaactgccaaacccagcgctctaatagtggcgagacttgccaccacattatatcgttacgatctgtattggcgatccctaaacaccaaataactgtcgactttaaatagcgtctcagaaataacttataagagaggtttattattagaactatcaataaagttagagcgataattttaaacggtttgatacaagttatctctttattagacataattgtccagatgtattacatgaactgagtgacttgctctaatgttgtagacactgatgtccggtttagttaagaaagattttggaagtttcacgatatcgataatgctgcgggagaagctttcaaattataagaaaaggcttttttttgttgttttcagagtagtttggtgacttgtccgtttcagaagtgtctcgaatacggagtgcaccttccaaaaatgtttttgacggcatcgaagagccaaactcttatacaatatatgacattctgaacaatgatgcaaataacttttaaagccttaatactctacataatatgnnnnnnnnnnnnnnnnnnnnnnnnnnnnnnnnnnnnnnnnnnnnnnnnnnnnnnnnnnnnnnnnnnnnnnnnnnnnngggagattaaccgaatagcaaactcttaaactatgaaaaggcaatcaatccactgttttctttttccatttcttctagcctatttgaactgtctgcttctgtttcttcattcatttcttgaatgattttatcctcttcttctgtcagggcacttatatcttgtgtcggtatgcattcagcatccattctgacacttggtgctccttgcaagtatctgatattttctagacatcgtattctaatgtcttccagtagttttttactgtttttgttttcgtataagtcatctaacacaggataaagtgaataatccggcccgaatgagtcccggaatgggatatcttcgggaatgtcttctggtagcaagacatcatttaaaattcctgtctcgtaggtccaaagccgtgatacatttctaggtgtataacctccaccgcccactactagcattggtagaccaaatgatttaacaaattttacgcattctccatgtgcctttatatttaaattgaagcatcctaagcgatcatgacctaaggaatccgcaccgcattgttggacaataagtgttggtttgaaagtcattattagaggatctacaatcgacttgaaaaggtttatatatgagtcgtcatctatgccatcttctaggggtacatttaatgcgaaatgttttcctttgtcgcaaccaatttctgtcagatcaccggttcctgggaaaaattcgccattatatttatgaaacgacaacgtgaagaccctatctgtggtgtaaaacgcctcctggacaccatcgccgtgatgtaggtcgatatcgatataaaggattcttgggtgatatcgtaataagttcaaaatagaaagcacaatatcatttacatagcaaaacccagatggactattcttttttgcatgatgaagaccaccagaccaatttatcgctatgtcggattgattgttgattagtttcctggtggcgtcaaggctcgcaccagtgtatagtgttgtataatcatataaattttgaaaaataggacagtcgtctccaatgttaaaattttcaagtgtgcctctgggcagtttgtttgcattttctggtgaaaccttcgagagaaaattcacgtagtcttccgagtgaaattgaagtaattcgtctctggtagcgcttcttgtttcataaaggtccataatcttgtgcaatccataagaggaaactaggtgatccgttagcattaaccgaaacggcttcattggatgcttaacaccataatggtaatgtgaaactttggagttaaaatgatacgataccctgggagaataagcagaattaaactcaaataatggttcgttctcctttgttttcacatcataactaaatgttccaggcatgttgcgtgttgttatttacttgatacctgattttaacgtacttgagtaacctggcgtcttttctataactgtacattggcgacacacctaaaactgattagaatcgtttcaagatgctttcatttcaacatttagtagcatagtaggaatatcacgtttaacgatgccccaaagaacatcgagaatcctctatatagagtataaacagggcattctacactggtatagaggtgccttaggtatatagtggtaccggtcacataaattgacgggaatatgtgtctttaggcggcttttggcgtacagtattgctttctttcgtgcttgtgaaacttgttataaacaaagaaagagaaagatctccccggcattctggaagatcggtaaccgctggagctataggaaagggagatggataacagtaaagaaaacggaccatataagttaacattgggggttttcgaaaaaaataagaattggcattcagacttgaattcataaaagttgtaagcaggctatgattaacgataaactagtacattttctgatccagaattatgatgacatcctaagagcaccgctttctggacagctcaaagatgtgtattcactgtacatcagtggtggatacgatgatgagatgcagaagttgagaaacggtaaagacgatgtcttacagtttgaacagttttggaatgatcttcaggatattatatttgcaacgccgcagtccattcaatttgaccagaatctattagtggcagataggccagaaaaaattgtttacctggacgttttttccttgaaaattctctataacaagttccatgccttctactatacattaaaatcgcccagttcttcatgtgaagaaaaagtgtcgagtttaacaacaaaaccgggagctgattcggaaaaagaccaactactgggtagactgcttggagttctgaactgggacgttaacgtcagcaaccaggggttaccacgtgaacaactgagcaatcgtttacaaaatttattgagggaaaaaccatcatcttttcagcttgctaaagaaagagccaaacacacgaccgaggtcattgaatacatcccgatatgtagtgactattcgcatgcatctctattgtcaacctcggtgtacattgtcaataacaaaatcgtttctttacaatggtccaaaatatccgcatgtcaggaaaatcacccaggattaattgaatgcattcaatcaaaaattcactttatccctaatatcaaaccacaaactgatatttcgttaggagattgttcttatttggatacctgtcataaattaaatacgtgtcgatacattcattatctgcaatatattccgtcatgcttgcaagagcgagctgatcgtgaaactgcgagtgaaaataaaagaatacggtcaaacgtttccattccattttatactctgggcaattgctccgcacattgtatcaaaaaggctttacctgcacagtggatccgttgcgatgtgcggaaatttgattttagggttcttggaaagttttcggtagttattgcagatcctgcatggaatatccatatgaacctaccatacggtacttgcaacgatattgaactattaggtttgcctctgcacgaactacaagatgaaggtattatttttctttgggtgacgggtagagctatagaattgggtaaagagtctttgaataactggggttacaacgtgataaatgaagtttcatggataaagacaaaccaactgggtagaacaattgttacaggtcgtacgggtcattggttaaatcattctaaggagcatttattggtgggcttaaagggtaatccaaagtggatcaacaaacatattgacgtcgatttgatcgtatcaatgaccagagagactagtagaaagcctgatgaactgtatggtatagcagaacggttggcaggcacccatgccagaaaactagagatattcggaagggatcacaatacgcggcctggctggtttaccatcggaaaccagttgacaggaaattgcatttacgaaatggatgtcgagaggaagtaccaggagtttatgaagagcaaaactggaaccagccacactggtactaaaaaaatcgacaaaaagcaaccttcaaaattacagcagcagcatcagcagcagtattggaataatatggatatggggagtggtaagtattatgctgaggccaagcagaatcctatgaatcaaaaacatactccctttgaatccaaacagcaacaaaaacaacaattccaaacactaaataacctatattttgctcagtaaagcgttaaataatccttttaaacattaatagcattgcataaaaaagatggtcataaaaaagactgcagagagaaataaatggtttcctggtctgtattagacaaactttggaatagagaaggatatgatttatgtccaataattattatccgagtccgtgtatttttttacatcaactggaacaatttattacccggatgtttaaaaactgttgtcgcctggagaaagctaatactagttctggtcatactttcaaccattaaacactattaatataattacttgacttatttgctcccactcttggtcggttctttcccatagcgcattctaccattctttttttctactccaatcgttcttactggaaactgtgggaatagcgaagaacgactattatttgctaatacggagtaagctatcctactgaataggtagacgatagtagtaatccaacgccgctatccattcgattataccgctatgaatgtagtgatatggtgcggtattgacacaatatagtaatttcgggtaattttttttcccaccaatgagaggcggtactgggagtatcggtctaagagaatcgaaaaataacccccagctgggatgtgatcacgatgagtgacgggatacattaaatataacaaacaaacacgttgccttgaacgttttccctacacatcgcatgtgttctatctagatttaaaatcataatattacagttctacagttatacaaataacaaacaatagaaaaatgtttagacagtgtgctaaaagatatgcatcttcattacccccaaatgctttgaaacccgcatttggcccaccagataaagtggcagctcaaaaatttaaagaatcattaatggctactgaaaagcatgcgaaggacacatctaatatgtgggttaaaatctcagtttgggtcgccctaccagcaattgctttaacagctgtgaacacatactttgttgaaaaggagcatgctgagcatcgtgaacatttgaaacatgtgccagactccgaatggccaagggattacgaatttatgaatatcaggtctaagccttttttctggggtgacggtgataagacattattctggaatcctgttgtcaacaggcacatcgagcacgacgattaattaattgattaagtgagaataaacttttcgaaaaatttttatttatgataattttactaattcttacttatttcttttatattcgataaaaaaattcaaaataaaaaaagattaatcctttgataggaactaaaggtactaggtattttgggcggcgaagcatcattccgttcttaaacatctatatatataattatattgcaaatgtataagcatttaaaaacataaacatgcacctatgaagaagaacttaagacgttttatttttatgttccacgcgttttagtgaagtgatgaaagaagttctgatagagaaatgtcggattaataattgatacagtgtttataagatagctaatcagaaaaaaaacgaaagaaaatggtataagtctcagaataatgataataaaacacgcttgaagtagaataaaaatataagtagagaagataaaatgaaaaaataaagatagaaagattttcaatgaggggcaaatctaaatctaaaaaatttgaattcaagttcaatttaaatttcaattaaaacagtagtagtatgtcgggaagatatgggataaaaaaagtaagggaaaataaggaactattataattataatgcggaaaaaatgaataaattattagttgctgcaacagcaatactattttctcttggatgccatgagaaatgtaaaatattcttcttgaaatcaatatcgtcaccccaatccttatttcttgcagacctttgcgctagcgaaccgtaccttttgttcctgaacgctgttttgtcagcttgtaacacgatttcattcatttcggttcccgaatcctccggatttgctccttctcctcccgctatactgcttctagagctattactacttcccaccatgcctgtgttgcgtccgttactcctacgcttgtggctgttgccactactactagaatctttattttgtatgctgttgtggatatttttattgctgttgctattgggtgcgttgtgttcatcaaaagttttgactatgccattatcattatcaccagaagttactacattaggatagatcatgaaattgttattgtaagaaccagtcattacacttgaactatcaccactaaaattaacttcaaatttatcgaaaatcgcatcgttttcataggtatcactcaatctttccttcaattgctcatgtatgtttatggttttcaaaggcttattatccatatttacgtcccaaattttgacagttaaataatctctggatgcaatatacctaccatttggactaaattttatgtcggaaattgacgacgtgatttctgtaaaaaaattatgattgattggatccaaatattcttcaaatgttttggttttattgtcacatagggaattctgtctcatatcacacaactttattgtacctttggaagaagagtacatgaataaattacattcttgcggatgaaattcagcgcttgtgatcacttcggtaagttcttccatattggttggcttgatatctacgatgttgaagctctgatctggtatgtccagattccataaattgattctcaagtcgtcagcacttaaaaatgtttcctgatcagaattcaacgatatcgaattaatgtgataggtatgtgcattactatatatacgctttggggtggcagcaatgattttgtcatgctgtgataattgaggcagtttcagcgattgtaaagataatacagccctcacggaacctcctctactgttatggttatcgggcttgccttttttcgcaaacgtaaccccttctgttaagttgttctggcttaccaattttatatttttctcataaactttccaaagttttatagttttatcatttgtgctcaaaagaaagtgtgatctttgagttggtcgtaaccatttgatttcatttatcttctcttcaatttctaaggattttaaataatcaaattctgcgtcatgactttgaaactccgttaaaaacttatactcgcaatgtctactattacttctttcaaaaagtaccacacgcccacctttatcaccagtggccagataatttccagtatagtcaaattctacagctgtaattagatccgcctctgtcaccacaatatctgctttatcaccaaaacattggctgaatttaaaatcaaaattgttttgtgccattgtgcgctatattatatttctttatgcgtaagatctccccagtttgacctcgatatgttggctagattttatgaggtttacagtctacagaaacactagttttccctttcttaatatgttggtggagtgggggtaatcgtattaagctgccttattcgccctctgataggaataaaaatcgaaacaggacgaaaaaagggtgaactaaaatatggaagagagcctaattgacgtaatcgaattcttctagaatgcgtttgtatattcaattttcaattcttccagtctcttcgtggtaagttctctaatgtaatagtcttgtcttgtgcaaactccctttatctttgacgggaaatgttaggcaaaattggatggaaaagagaaaaaaggaaggaaaaaaacaaaaaaaatctacttagttaaggatctattgacgtgcgcggggggagtatatgccaattgtctcaaaaaaaacgtttatgccgtgccggaatagaaatagttactggtcgttttcctatctgatataaatctgagtaaaacgattattgtctaacccaatgcaatatatacagatagcattccgctcatagttaataattaacttcagacagtttttttcaatatctcattaaagggaagaaagggaggcgaaaaaaaaatcaaaaaaattatacttcgtatcaaattatattcgtggaaggtgacgatagtaatatttgatgttgaacatacttgaaacattaacatatttaatagaaaactattgtaatggttattttttattgattagaaatagtagaaaaatttacttatgtttcacctatattaatcaagttataaagccttcttggcggcatcagcaggggaaaccttgttttctctgttgaatcttggtctttgaggtggagctctgttctttctgtcttctctggatctgactctgacaattctggcgtgaatagcacaagaaacacagtagtgtaacttgttgtaagtctttggcaaagcgtattcagggtagacagaagcttcggacaaatctctgacggcagcggcttcaacaatgtttctgatagccattctcttgatagccttatcctttggaatagacttggaacagttgacacatctgactggtttgacgtgacctctacctttcttgtttctaccgttggaagctctcttctttggcattttgaatgatctaattaaatattcatcacgagtattgcaggtttgcaaagagttaaaataattagttagtaacttctcaatttttttaaaatgatcgtggcaaaaagggaaggagatatttacgtaacatttgaaattttctcggtacaatattcttcaataataagtacattgcatacgatgggcgacttccttctttttctttagttagtgtgaactcatgattggcacacttctagtgattaactggtttcctttcagaaaacaagttacatttgccatgttttaataatatcttgtcactattactttctcccaattcaaagatctcatcgttcttcccttctctactttcacacttttgtgtcgttaacatactacttaagactatggttcttttatctgtaatagcgaacaaattaaatcatttactataacgaacattaaatctagtaggtatttcaaataccaagtaatccctcaacactcaatgagaacgaagcggtgtaagctgacacttcgagttccgcctatgttactggatatgagccctccccccacgaaggttttttccttccagagccgagaacatctcccaaggagaacgaagcaataccggtaagctgcttaccgtcggggcagggaagttcaattcaactccctgtgccgagaatttacttttttcgaaaaatcgacgtctttaaaaaaagaaatcagtatgtatgggtgggtgtatggatgctgtaagcacagtctagaatcttttggaagtaacttcgcaacaacctctagctagccatctctgacagagatagaaatagtaatcagttatgacatgaatagtactaatattaataagaatttttaaataaaaatatatctcgaccttttctcgatctttttggttatgtattttttggctcttcattatagatagagcaaagcgttcgccttaaccttcctgcaaagaactttcttgtggaactttgttaacatgacgtgtgtaaaagctcagacctggtaagaatattcgctaggtttccaaaaaaaaaaatataaataaagaagaaggtaaaaagtaaaagagaaacagaagggcaacttgaatgataagattagtgatggtggtcatcatttggaacaccaacagggtttagtttgtaaacagaaccacattcccagcatctggcgacttcgttaacagttggttttaaccacataatagtatgtgaaccagcgggagaacccgtacaaccgacataacgataatcatcataagattcaatgatgatcggatctttcatggtacccttcctggacgaatctaatggtttggtgtcgaaaacatcgataccctctaatttacccaataattctaacctagctaaaccagtttcttgatctaggtctgttggaacggtaccctctttagcaccaggaccaatcaaagtttctggaccattaacttctgctaagttttgggcagttttcaccacgggtttttgctgaagcagatatctagagctacacaaagttcttgtggctggcttgaaaaatcttatagattgacgtagtgaaagcattgtgcttgttatctatttgtatggcaacatcaaaatcgaaatgggtgagtattgttagtatactgtttcttcagggagaagaatacgttgactaaaggaaagtgacagggaatatttcgcatcgaattcttcattatatgatggacaatttggacaattatgcaattatcgtctcaagccaaatagaaaagcagggaacgagttaaacttgcaaataaattttttcttaaagtcaaatccagatttgttttctcttagttcttttccgtttcgttcgatctgttaaatatcttctttcctggtagttcttctcctacatctcatgtatttttcaataagaggattataacatacatttcaaaataatcttatttcctgtttatgctaatttttacgcaattagcgtgcctaagtacaaaaaaatgttttgtaaaaagtatgaaaaaaattctaatcttcgtatatctttctttcctgtgtttatacttggaagaagcgaagtattttatccttgagtgtgtcttattttctcttccctttatttgctactaaccaagatgggagatatcgctttttcgaaggacgcctttggaatccgctgatcttattggtggacagtcagctgacagaaaacttagatcgtgacagcaaattaaacgatttgtgctactgttcaaagtgtcagtatatcactcgatgatttcaattgtccaccaggcttagattttcatgtgaaaagataatgtgtacaaaaaaatatcctccctgagcgtaatttaacataccatgaatctacctgccaatattatctaaactaaagtttgccgctgcaccgtagttttaatatatacttatgtcatttcaattaacgaccaaatttacgtagctctaagtatctacaaggagggtatacaacacctgagaacgccatacttaaccacattgcgacatcaccaccatattcaccaaatttggcagcaattgggccaatccaataggcttgcgccataccaactaccacaccagcaactcctacaataaacgcaaatgttgctgcataaccgtgcgttaaaacctcataatcttcccatttgtcccaattgtaacgatgtttagtcaccttatgttttctttttaacaaatggatattagtaactgcatctttctccacttcttttgaagatccaacaagttccggtccatttatttctcctgtaactgtaggaaactctttggtgtacaaatgtaagaaaaaccttctgaatactaaattctcttcgaataataagataaagtacatgctaatccagtagcctatcattggtaggaaatttcccaaaatagtactaaaatgattacgacctattaatgcgcataccaaacaaattatagtacaaacaatagaccagaaccagcgagggatttttgcacaaaacacactagaaagttggatggagaatgctgccgaatacgtattgatgatgttgttggataccaaactgaataccagtactaccacgcagaactttccgaagccgttccaacgctgaaaacctgcccaaagtagaccacccattccatgggaatcgtactcgactgaccaaggcttatacgacatggcaacagaagctagtaagagacctaagattccgacgaaacaggtaggcaaaaatgttccaaaaaacgttaggcaaaaaatttgaatatatggtgtatcttctgggaacaatatataatagtctgctgtaatagacccccaagtagccgtaatactatagcataatgaaaaaaaactcatccagttgccctttcgggtggaagagtccaaatttccctttgaaacgtatgcattgacgaagctgtatttatcacttgatgaaatgtacagtagtaaaaatgctgtcaggacgggtacggataagtaagtttccactttaatgacttgtttgataccgaaaatggcaactaaaaaggagcatacggtcactatgacaatccctacccataggggtactttatcattagaaatagcagctaacatttcacccccaaccacggaattaaccacagaccaacccatgacaccgataatggaagctaatgcaactaatttaacaaaccaccatccgaacaggtatctagctgttaccatctgtctgcaaccggactgcggtcccatgatcgagcaataggcagcaattaagcaaccaattgttaccgatattaaactggaggctacggattctctaaagcttaaaccgaaaagcagagggcctaataaaaacgacgacatggaagacaaaccacctgtggcactcaaccatagccccgcgacatgcaaaaattgtttctttgatgttcctcgttcatagggagatatcctctgaataccggtagactctactcccattgcgtccactttcttagaaagccatgccgccctgttgataattcttctcaaaatggacggacttgagttggccttttctgtggctatgtttaaagaagaagctgcggttccttcttcgtaaaattctattacatcagtagtatgctttgtatgatcttctttgcgctttgttgtgtccatgttgtccctattcatctatgatcgaagtttttcaagtcctgttctttgataaatactctataaagctaataatattcaacagtaatatttttatactgagaacctcaacatctgttctcttttttaatggccttctcttagacaccatcaaagcagcctgacgcagaaaatttcaggtgagataaggtgcggcgaacaaatccgaaatttacttacacgcaagtacgagtcatacacctacggggcactgtactacaatccattgtcgaaacaaaaacggcacttaatgttgacttctttttgaagtcaaatgcatacgaaaactcgcactgctcttttttcttggtgtgttgacgtatatgtatatataggtatgttaacataaggttcttacgtctcttactatcaaactacacgggagaaatgctcatcgcttgcggcttccccagacactacccgtaagattcttgtcaatgccagttcacaactttgctcaaaaacatcctttgtcgcactacccaaatgcggagtaattgaagtaagtctatcagaagatctgattttttcatctatttctggttctttattaaagacgtctaaaccgagatggttgattcgtcccgttaccaaggcgtcagaaacagcccgcaagtccaaaattttacctcttcccaagttgactaaaattaggcctggattgcagtgttccaaaaatttcctgttgattaaatgttctgtttgtggagttcccggcaatgtgaccacgattgcatgaaactggtatagttttgcatatattgtttcatctagcaaatgaaatttccagctttcgttttgactcattgtgcaatcttcgcttcttttgcaataatgtatttccattcctagcccgtattgcaacttgtaggctacttgctttccaatacttcctaaaccaagaattaagcatttctttcctcttggtgattcagcaaacatattccccagttcatggccaaaagcaaatccgctcttttctgcagctttcgcccttgcagttaatgtatttccagtttctctactaagtttttggtaataggagaactttctaaagccctccagaatgtgccacaaggcacaatctgccacatcattaccgacttgatgaagctttaaatcgtctatcaatttttcattttcatcgtcttggtagttgtataatcgaatttcatgcttgcgtaatgtatccagatcccatccgtcgtaacctcttgagcaaagcacgatacattttaaatttttccttggaaatgacttgtgttcgatgatacttcgagtcatcccaccgatttttttgaatgccggaaacccagcataaatggcacatattttgtcttgttcatgcctttctaaaaagttaagaaatgcttctttggtgtccagctgatagcgcaagatcctgaacttctctttgaatgccttggaattaagtgtggctgatgtttcgcacggatctgcgatgaaaagaatagtaggctttccagtcgttgcaggagaatcgcacattttttgtatgctcttttccttctaaatctgctgtcaacccattgtcgagtgaagttataaaagcacagctatttctatattccttttacgaccgccattacacacgttcattgaggcaaactttcctccttcgcgcgtgcgtttcccaagggtagtagtaagagcttacggaacagcccgaaaggctgtaaaagtttaatatacttactgttcttgaaattctgtctatatacttgactatttaaagttactatctttggatttgaaccttataaaaaaaaaaaaggtacatgcatattttcccttacaatttcgaactcttaatattcaattctgagtcctttctgatgagatcttgattgtaaaattcttcgtaaatacttaaaggcttatgcaggtcatcgatggtagtgttcacagctaggttcttattcaatttgttgaaaagatatttgccattttctcttacttctataatatcagcgtcaaccatcgccgctaataaatctttcttcaaatctactatattttcgataccgcagcaaagacgaaccaaatcttcaggaaaatctctctctttccttaattcgggatcaatggaagcatgggacattttgcaaggcatagatagaagcgaatttacacacccgaaagataccgtcacagcccatatactcagttttttggaactgaccagtctctttgaatgttcgaaggaccccgtttcgaaggataacacggcacctgggccattattgaacgatttatgcagcttgaaatccgggttggagcgtaatccaacaaatctagttttcgtagccttgtttgttctggtaggtttgaatccgcatgaattttctagccaatgagccaatatcatagcatttctctgctgttgatataatctaactcctagagtttttaggcccctcacaagtagccaagaatccattggggataatccagctcctgtagaattaatgacaaagtaaagcttcgaggctatttctggtgttttgctgataataacaccccccatcaaatcgtgatgaccattcaagtacttggtagcagattcgtatacgacatcgcagcctggattcagttgaagaggattacaattgagtccactcatcatagtattatcaacgacaactgtagtgtcgggagatatgcatttcacaaaacgtaatattctagggatatctacaaccttgcaaagcggattggtcggagactctagaagaacacaatcaactttatctaaagactggaaaacggttttgaacttttcaaaatcggaagtgtccacatgaacagagactgcatgactctgttgcttgaaaaaattcagcagcctttgggtgcctccataaagatcatcgccggctattattgttggcgtatggttgtcagtgccgttaagtaagacgagcccacgcaggatgacgtctagcgccgtcataccactgctcacagctaatacgttttcctgtgggacacgataaagcttaccaatctggtgttgaaggacacttctggtcgggtttcccgatctggaataatcgtagttctgtgcatcttcattattcaagtccactttgaaggtagtcgacaaatacaccggtggcacggaggctgaatgttggtcattttgagagccggtatttaccacaactgtatctaatctcttgatcggcatctttttgcttctatgcttttgttgtttgcttgatattttttgtttttaatgaactgtaagcacacagagctatgggatgtgtggcaatgactgtatatatatgtatatatatatatatatatatatatatatatttatttatttatttatttaaaatatagctacgtatgcgccagttgtttttatcagctttgcttctggccacatttcaaccaggtctcagaggatatatggccagaaggcccctttacacacttttgagatgcgatgagtcttccaaggtaggagcatatgcctccaacagacttcggcccgaagcatgctgtgctcacgggaattatattgtgtgaagcacatgccacactttccaaaaaagagtcagaatgagtcagccggataaccaaacgcggactgtggcgccacggaaaacagtgtggcaaatttatgggcggctaatctgcaagctctatgcctggaaatgtagatgtaataatcaagacacttttgttctttcgtgtatagtgcatgaaggttaaacctccgtaaattccttgaactcttctggaattccaaattcttttcttatctgttctggcttcaaaaagaatttcttgtataaataatcaatgagaatctcaatgttatcagtagttttctccagatgcactttttttaggcggatctgttgtttattctcttgtatttttgctgcatcccatctaatgctttctattttttggagactattactctttttcttaatttcatcctgaattttttttctcttttccagtagagcctccctattgtatgatttttggcctaccgtaaattttttacgccttccagttgctagcgttttgtctagttcttgtttataagtggcaatatcacactttacttcctgtatctttttttttatcaactcgcttgaatcatacaatttttgcagtgtctgatttttaaagcaccagtagatgttaatattaccacatttttccaccgaaatgacgccgtcttcatcaatcatttgttgcactaaatctttaacgatcatgggtgagattccgcattttttaggtatgcttttctctaattccttgatgttgtagaatgtgtacgtctcttgaaaaaagttcagaatccggttctttttctcttggagtgatactgtctgtctctttggcccctaataataagaagagggtagcacgcacccgtctataagttagtgttcagtcctgtgtaccatgatggttttattagacataccattgttgaatgtttatgatactacacataaagtttccgccgtttagtctatatcgcaaagaataacggtgggacgggagatcgccttttatatgcaatttcgtgatctgggcggttattttactttttttcgacgcataaaaaagcaggaaagatggtaaattcggttcgttattcaagatttttagagccagaaagatatttgagcgtgccttcgtgagaagaggcttaggttgagacgatgatgctgaaattatggcaagacacgaattcttcttcaagtttcccttgtcataataagaagagaaaaacatacctttatgtcggttgcaattaagaaggttgtatagagcatctcaaatgctgcttttactttattaaacgttgaccaaataatacggcgcttttgtttcgacaacgacacactatgatgcaaagcggatccgggtaatcgataaatgggggcacccggaaattattgtaagttgaagaaagttagtgttgatctctaaatgcttcacaaaagggtggaagaagaacattttctcttgatcaatcattaatatagatggaggcagcgttctgtcaatcacagattatagtttatttatacttagtcaaaaatgaggtttaggagttcttcccatagcttaaaacatgttgacagagaattaaaggagttgattaattcgtccgagaatgccaataaatgcggtgaatgtggtaatttctacccaacttggtgctcagttaatttgggggttttcctttgtggtaggtgtgcctctgttcatagaaaagttttcggtagcagagacgacgatgccttttctaacgttaaatcactatcaatggatagatggacaagagaggatatcgatgaattagtgagtcttggaggcaataaggggaatgctcggttctggaatcctaaaaatgtcccttttccttttgatggagatgatgacaaagccatcgtggagcattacattagagacaagtatattttgggtaaattcaggtatgatgaaataaagcctgaagactttggatccagaatggatgattttgatggggaatcggacaggtttgatgaaagaaatagaagtaggagcaggagcagatctcattctttctataaagggggccataataggtctgactacggcggttccagggactcattccaaagcagtggaagcagatattctaggcaactggcagaactcaaggacatgggtttcggtgatacaaacaaaaatttagatgcattatcgtccgctcacggaaatatcaatagagcaatcgattatctagaaaaaagttcaagttcaagaaatagtgtatcggcagcagcgacaacatcaactccgcccctgcccaggagacgtgcgacaacaagtggcccacagccagctatttttgatggtacaaatgtaatcacgccagattttacttcaaattcagcatcttttgtacaagcaaagccagcagttttcgatggtacccttcaacagtattacgatcctgctaccggaatgatatatgtagatcagcagcaatacgccatggctatgcaacagcagcaacagcaacagcaacagcttgctgtcgcacaggctcaggctcaggcacaggcacaggcacaggctcaagttcaggctcaggctcaggctcaggcccaggctcaggctcaagcacagcagatccagatgcaacagcttcagatgcagcaacagcaacaggcgccattatcttttcagcaaatgtcgcaaggaggaaacctgccacaaggttatttctacacacaataaaaataagatacattgccgctgctccgcattacatatcatatagagtgacactaagtaattaaatgacactaagtaacgaaagatatctgtaaacaacgactatataccagaattagtcatattctctattgtattcaccctacacagccgcattacacagctgctccggacgttttacgctgcacatcaatgactaataccactgtatttgatccacacttagcgcaaaagtcacctgggtggcgttttccgctcgcgctccgccggtgagagcgagaaaaaaaaaagggattgggcggtaatgtaaggaaaacccactagttaaaatcaatgagataaggaactctctttttttcccgttaatcatcttttccttgttcgtttcgtgtatctgtaatgaatcttatcggagtaactattactggaaagccataccgttaaagaagcaagcatatcattcgtattcaagcatctgtttttctttttaaccgctcggctctgatttcttaaaccatttcccccatcagcatcagtttgtgatttgtaactatatcgatcgtggaatcgatggaattctaagcgtcatttagttggcaacaaaaggaatcgagcatctcataaaggagcttatattattaatatcttcctgatcgtactatttttttttagctttttattttttaggccgaggttaattctagaacgccacatttcatcacctttaagttaagtaccaaggccatcttttaccctttttagtttctggggaaacagagaacagtactatagaagataaaaagatataatacaatcgtagtaatagtacccataataaaataacatataatataataaaaacataaggcaaaggagataggagaataatcattgatatctccacaaaacgaatttgaagctaccccatattttcaaatctcttttacaacaccagacgagaaattaagaaaatgggagacattaaaaataaagatcacacaacctctgtgaaccataatctaatggcaagtgcaggaaattacaccgctgagaaagaaatcggaaagggttcgtttgccactgtatatagagggcatctgacatccgacaaatctcagcatgtagccataaaggaagtatcaagggcgaaattaaaaaataagaaattactagagaatttggaaatagaaatcgctatcttgaagaaaatcaagcatcctcatatcgtcggacttattgactgtgaacgaacatcaacagatttttatttgatcatggagtactgtgctcttggggacctaacatttctgttgaaaaggcgtaaagaattgatggagaatcatcctctactaaggaccgtatttgaaaaataccctccaccgagtgagaaccataacggcctgcatagagcgtttgtcttgagttatttacagcagttagcgtccgctttgaaatttttgaggtctaaaaacttggttcatagagacatcaagcctcaaaacttactattatctacacccctaattggatatcatgattcaaaaagcttccatgaacttggatttgttgggatctacaacttacccattttaaagatagcagatttcgggtttgcaagatttttgccaaacacgtcattagcagaaactctttgtggctcaccattatatatggcaccagaaattttgaattatcaaaaatataacgctaaagcagatctgtggtctgtcggtacagtggtattcgaaatgtgctgtggcaccccaccgtttagagcttccaatcatttggagttattcaagaaaattaaaagagcaaacgatgtcataacgtttccttcatattgcaatattgaaccagagttaaaagagttgatatgtagtttattgacatttgatccagcccaaagaataggatttgaggagttttttgctaacaaggtagtcaacgaagacttgtcttcttatgaattggaagatgatttacctgagttagaatccaaatcaaaaggtattgtagaaagtaatatgttcgtttctgagtatttatctaaacagccaaagagtccgaacagtaatcttgcaggtcatcaatcaatggcagataatcccgcggagctcagtgatgccctcaagaacagcaatatattaactgccccagccgttaaaacagaccatacacaagccgtagataaaaaggcttcaaataataaataccataatagcctagtttcagatagaagctttgaaagagaatatgtggtggtagagaagaaatcggttgaagttaattcattggcagacgaggttgctcaagcaggattcaatccaaatcctattaagcacccaacttcaactcaaaatcagaacgtcttattgaatgagcaattctctccaaacaatcaacagtattttcaaaatcaaggagaaaatccgaggttactgagggccacatcatcttccagtggaggtagtgatgggtctaggcgaccatctttggtggatagacgcttgtctatatcctcgctgaatccatctaatgcattatcaagagccctcggtattgcatcaacgagattgtttggtggtgcaaatcaacagcagcaacagcaacaaatcacatcttccccaccgtacagtcaaactttgttgaattcccaactttttcatgaacttactgagaatataatattaagaatagatcacctacagcatccagagacactgaaattagataatactaatatcgttagtattttggaatctctggccgcaaaggcatttgttgtttactcttatgcagaagtgaaattttctcaaattgttccattatcaacaacattaaaaggcatggctaactttgagaacaggcgcagtatggatagtaatgctattgcagaagaacaagactcagacgatgcagaagaagaggatgaaacgttgaaaaagtacaaggaagattgcttatccacgaaaacttttggaaagggtagaactttatctgccacatctcagttgagtgcaactttcaataaactaccacgttcggaaatgatccttctatgtaatgaggccattgtcttatatatgaaggcattatccattttatcaaaatctatgcaggtaacgtccaactggtggtatgaatctcaagaaaaatcatgttctctaagagttaacgtgttggtacagtggctaagggaaaaatttaatgaatgtttagaaaaagctgatttcctgagattaaaaattaacgacttgagattcaagcatgcttctgaggtagctgaaaatcaaactttggaagaaaaaggtagttcggaagagccagtatatttagaaaagctattatatgatcgtgcattagaaatatctaagatggccgcacatatggaattaaaaggagaaaatttgtacaactgtgaattagcttatgcaacttcactttggatgttagaaacttctctggacgatgatgattttacgaatgcctatggtgactacccttttaaaactaacatacatctaaaaagtaacgacgttgaagataaagagaagtatcatagtgtgttggatgaaaatgacagaataatcataagaaagtatattgatagtattgcaaacaggttgaaaatattgaggcagaagatgaaccaccaaaattaagtgatgcataatatggttttcttattaagtacaaatgacctgctatattttcaagtatcttcatgattatgttatgctactctcgaaatgctttacgagttcgtcattaaagtattcaaattttattttccctttgtgttttgttttgtttttatttctacgtgatttttttcttgaaatccagctcttttatacctggatgggttttattttgatgtttaaatgttaattaaggaaattattgaattccttcggtttcggtgtgtttttttctttttaagtttttttttgttgcgtttagtacttgcctttggctatacatatccttttaatctaatttttatttcttcaaaatttgattctttaaccttttgttctatatatatatataaatgtatgtatgtatgatttgattgaggaggctttaacaagtcattaatatctttattatttttacttgttgagttcattaaaattcattttataatttgttgttacaaacagtattttacaagtcataataaacgttcaaaaacaaacacaatattaaaagaattggtattaggatccgacatgacaattaacttagatccttctatcaagtttctaatcatatattacatctattaaaataatttacatatatcatgctaaagcttataaagagacattcttcttctcgtgcgctgggcgtcgctagcctcaaatacaagtgatgcgtctgcttctattctaaggtcatccttgctgttagatttcccttctaccaggtgggcttttatacgttgaggtacattaccgacaggcgtaagagtagagctcaaacttgcttccgtactctcaaagggatattctcctacaggagacatagttgtatattgtggaaactcacaagaattcactcttaatgaacttccactctcacctatcaagcattgttgatcaccgattgctggggcatcctgaatactgatctgagatgcaaaagcggtggatgatgtgaaagaggaaaaggacgaataggatgactctctagaaccgatgttgtgatatgctgagggtgataaggtatttgcgtcgtatattgatggagaatatgttgaatttctgtcagcaccagtcctaaggttattgtggtcaaaattttccatataaacgctatctaaagaggcgaatgatgaattcactggtaggctgaccaattctacccttttgcatgaagagggcggtgaaactttcaactcatgaaacgtctccaaattggtcaatacggatgctgcatcgcttttaccataatggcacataaacggatgtaccttgatgtctgctagttttatccgtttgtcaggatctttttgtaacagcttcttcaataaatctttggcatcagtgtattcttccattgtgattcccgaagtggcaccattcaacatttcctcataagatggaaattctaagggtttattgataatactgtcgaaaagttctaatcctgaattggcgttgaaaggcaactttccaaacaacaagcagtatatagtgacccccaatgaccagatatcgatggcagatgagcaggaatactctttttcagtggagcaaagctcaggtgcaaaaaaagcaggggtccctaaggctctagattttaaaagttgttcatgcgatgattgtatattagtacttccggtggcagttgacatagcaacgccaaaatcggatattttcaccgttccgtttgatgaaattaacaggttcgatggtttgatatctcgatgcgttatcccttgggaatgtaaatactccagacccgatactacatccaacactaccttcctcgactgttggaaagtgagtattgatggtcccactgcttttatctccattttgttttctggacaccatttaacgggtccccttgagcaatattctaatacaagataaacctttgtgctctcagggtcattcaaaatttcatacaattccacaacgttttcatgatgacatcttttcattacttcaatttcttgattaacccttggattttctactttcaattgaagagaatacccgcttcttttttcgaatctattaagaatttttattgcaaccaacgcacctgtcccgagatctcttgctaatttcactttgccgtactgtccattacccaaagtggctaaaatttcaaagttgttaaggatttgtctcttagttaagggattatataatagtttgacttttcttgtctcttttatacgactactactattgctcgcattattatataacagagatgatcgaggcagcggctgaacaggttctttaagtagtaccatattcttcaaagcttcctttttatatgcagaatatgtgcgcagcaatttcaaggcgtagagtacgagtcactagaggctcgagcattatataccacttacaagtagtgtttcttattggggacacctgtcctaacaatgtatggctttatataccgcgcggataagtaaggcacacccgctcttcgtataatacccgcacaaaagattcagggaccgggtatgctcaacgaaaaaaatagccaagattgttgcgagtcctcatcaatgaggacatacagagaataaaaacagccatattttgcttgctgaaggacgttgtgcaaaccgaagatatcagcggtagtctttataggacccgttggtttattatatacaaagggatctttaaaaggtccggtgcgaggggacgggtggagatggaagttatcaaccaaatgcaatttatccgaagcgcaaaaaaaataaaggtgctccgatggaccttagaaaggaactccaaaatgctgtgatggaccggcgagggcggtaaacgaaactaccacattgcataagaaacaaaatgtacggccccttctacacaatctatttatggttttcgtcttgacctcctaattacttaattaatgattacatttcttaaaagcacaaaaataaagtagctacccttcttaagccatagtagttaaagcctcaagtgcattgataatctcctgaccctaggtcgtctttcgcgtgggctatcgccacctaaggaaaggattaaatggagcaagtattggaaatgtaaagaaattgcagaatgttctgattacttttcatcacccaaagagtccatactaccactaccaccaaccattgccggtgagcggtttcttgctcattaacatgacgtacaagggaacggaatgtcccttgtacgttgtaatgtcttttgctctcgtaaagaagcctatacacgccccttccttccgcccttcggcatccgctgccaactgggtgggggctcaatggatctctttactctggcccttagaagccttctgaaattctcggcttaggcatcgaacgatgaagaaactaactaaaaatatacgccatttttttggggagggggggccgcactgaaacgcgaaatgccaaaaaaacgcgaaacgccgcagtaaaaggtcagtaccgcgcaaaaaatacaaaaatgacaacaatattggcctttcttttcctaaagcaattaactggaaagcgaggttctaaacatctggccaacccctaaatttttaataattccgaagcgggatatattgcatctggcaatctgaaaagcaatagaaagaagcggcctagtactgcatagtgagtgataaaatatacatattaaggttggggaaatggtacgcgctttcaagtagctagaaagatctgaatgttctgaagtacggtttggatttatacgcggttatttcctggactagcttagagccaattaatactgacgattgcctctttttctttaccgtttatgtatgctgtatgcccttttcatgtataaaagaagggtaatttaaaaaagtttataatcatccagattccttattttttttcttctttcgccaggtgttttacccagctaagactaaccttgtggttcagattacactagtattgccgtccgatattacaattctgaaatcagttttcttgtgatcattctttttttctctcttgccattcttaaacgtggcctacaagaactcttcttctttcctggttcgcatctgtgttaaacgtatagattttcttacatagaggcctaaaaagcataataggtggtttcctttcaatatatatctgaaacattgaatatactgaacacaattcacatttcaaaaccttgggtactgttgagtcaacatcaagatcagcctatttcataatttactttatcttttcacacaaaaagagaacaggtaaaaaagaacagatctgctagccccgagaagatcattgacacatcattgattggcaagttaagtaataaaagaaaggtaataacatcaagaagtcaagcgccttgaaattactagatttggactacggatcagcaaaagcctgctactacaaccgccacttttactattccttaagataaaagctaaaaaaccaaaaaaaaaaaaaaaaaaacctcctcaactcctctccaacacatagtaaagcgaattctacgcaaatttataaatcaattacgatttttccagtttctcttatggtatgtattatctcttaattcccaatatttttcttcgccaatggagcataagctttaacgggatcttctaacaacaaatagcataataaccaaaaaccagcttcagtgggatcagcctatcgacacgccttttttagcggtctaacaatctccgtttatgtcgtatggaatttctgatacttgaccctaccttatttctcgaatatgcctataaggattttctcgaaagaagggcttcgggaaagaggcgcctcaggcaaaaatgagcaaaaaaaaaaaaaaaaagaaaagattcgaagatctatgaaaaatttatgcagattcgttgagagttataaggattttactctttatggttataggtttcattctaaaatcaagcataaattttgtgttttgtcttcctcttttcctgtcctctttttttgccatcctctgtcgccattgaagtcgaactttatagatagatttactcttgattctcacgcatctcaggccacctggacactgtacatggttgtgattgttctctttctcagttatcgaaattgatcctaggcttatactccaaaatcggctctgcacacgccttatttttgtggtttcactttactaacacaacattcttttattcaatcagatcaataacgaaccatttccatctgccgactcagcatcgattttaactacgtctacatcaaataactccttaatgtcttacaatcatcagcctcaactatctattaactccgtccaatcactcttggagcccgtgacccctccgcctttgggccagatgaataacaaaagaaaccatcaaaaggctcattcgcttgatctctctggttttaatcagttcatatcatcgacacaatctcccttggctttgatgaataatacatcaacatcgaattctgctaactctttttccccgaatcctaatgctgctagcaactccactgggctttcagcctcaatggcaaatcctccagccattctaccattaatcaatgagtttgatctggaaatggatggtcccaggagaaaatcaagccacgatttcacggttgttgctccttcgaactctggtgtcaatacctccagtttaattatggaaacaccatcctcttcagtgactcctgctgcatctctcagaaattttagcaatagtaataatgctgcttccaaatgtggagtggataattcgtcatttggtttgagtagctcaacgtcttcatctatggtcgaaatcagcgcactaccccttagagatctggattatatcaaacttgccactgaccagtttggctgccgttttcttcaaaaaaaattagaaacccccagtgaatccaatatggtgagagacttgatgtatgaacaaattaagccatttttcttggaccttattttggatccgttcggtaactatttggttcaaaaactatgcgattatttaactgccgagcaaaagacattattaatacaaacaatatatccaaatgttttccaaatatcaatcaatcagtacggaactcgttccttacagaaaattatagacactgtcgataacgaagttcaaatcgatctcattattaagggattttcccaagaatttacttcgattgagcaagtggttactttgataaacgatcttaatggtaaccatgtgattcaaaagtgtattttcaaattctcgccatcaaaatttggtttcatcatagatgctattgtagaacaaaataatatcattaccatttctacccataaacatggttgttgcgtactacaaaaattactaagcgtttgtactctacaacaaattttcaaaatttctgtgaaaattgtgcagttccttcctggattaatcaacgatcagttcggtaattatatcatccaatttctgttagatatcaaagaattggacttttacttattggctgagttatttaaccgtttatccaatgaattatgtcaactatcttgtttgaagttctcctcaaatgttgtggaaaaattcattaaaaaattatttagaatcattactggatttattgttaataacaatgggggtgcctcccaaaggactgcagttgcttctgatgacgtgattaatgcttctatgaacattcttttgactaccattgatatattcacagtcaatttaaatgtgctaatcagggataattttggtaattatgcgttacaaacgctattagacgttaagaattattctcctctgcttgcttacaacaaaaatagtaacgcaattgggcaaaacagctctagtacattgaattacggtaacttttgtaacgatttttcattgaaaattggtaacttgattgtccttacaaaagaattacttccaagtattaaaactacatcctatgcaaagaaaattaagttgaaagttaaagcttatgcagaagccacaggtataccattcactgacatatctcctcaagtcactgcaatgagtcataacaatcttcaaacgattaacaacgaaaataagaacccccataacaaaaatagtcataatcataatcataatcataatcataaccatgctcacaataataataacaataataatcaaaagagtcatacccgtcatttttctttaccagctaatgcttaccatagaagaagtaacagctctgtaaccaataatttctcaaaccaatatgcacaagatcagaaaattcactctccgcaacaaattatgaacttcaaccaaaacgcatatccctcgatgggagcaccttctttcaattctcaaactaacccaccattggtaagccataactcgttacaaaacttcgacaaccgccagtttgcaaatttaatggcacatcctaattctgctgcaccaatccattcgttctcatcatctaacattaccaatgtgaatcctaatgtttcaaggggatttaagcagcctggatttatgatgaatgaaaccgacaaaattaatgctaatcacttctcgccatactctaatgcaaatagtcaaaacttcaatgaatcttttgtgcctcgtatgcaatatcaaacggaaggtgcaaactgggattcaagtttgtcaatgaagtcgcagcatattggtcaaggcccatataatcaagttaatatgagccgcaacgctagtatttccaatatgcctgccatgaataccgctagaacatctgatgaacttcaattcactttgccataatacttttttttctttctttttctttccttcttactgtacaaatattttacgcagaaatcaaagacaaaagaaaaataaaaaataaaaaataaaaaattcaactaagcaatgacgtcctactaaagtcccaaaatttgagccggaaaaaaatggtaaagcaaactattgccatctttatattttgtattctgtttccgaacacgtatccaaaatcctcccactgcctttgcagggttagcattgctccctaccaaaatgatctaatttttttttgaatcgttttttgtcaacgattatttttgttttaaattcctcatcttctgaacttacgcccaactattatttaattcattcattcattaagcaatccatacgtccattcattcattcagttttctttttgtctattactgtcattttattttcaaatccaattgtcctttaggacactaatgtgttaaaatatccattcgctcaagcatttttaataaataggaaaataccgtttgtttttctttgtcatttgtataaatttttctactggttcctgtcttggttggctttattatatttaggtttaacttgtactaacaatgatacatatttgtatattttattataatatcatatctaactatatctaaaatcgttgaactattcagaatggaattgtacaccaagaagaattatgctataacaccataaggtcattacatttgggttttgactgctaattagttcgaagtcggcgttaaaatttaaagaatatttatacatatgaatatgtatatgaatgcaaagtatgctaaaatatttataaagcaaaaatctcggtgggctaaactaggtcaaagcagatgttatgaagatattggccccattgtagggatcatcttctctccgaattaagatgcatattttttgagaaagtgcttcttcaggtatatcgtaaggtgaagtactgctctcttcacctagaggttccacagcatcaaacggatttacgtaccttgggggtatgaaagccgaatgtaggtggatagattcaaactggaagttttctaacctacagtagttcttcatacctcctattggatagagggtgatatttccaccttcggatttttcgtagtcaagatttccagataaagtggtacaaaatacttcaaaatcaccctttccgtccctagcgctagttgaaccataaatgaagtagcgcccgtcatccgatatctcgagtatttctgtatccttagtcacgtttaagaacttagttttaaaagatacaaccgggatttcggtcagaatgtcctccaggaacgtatctgctataaccagttgttgcacattctctttgtctgccattccagatataagtattaggcctttattattcaatgcttttatggaaacaacagattttagggaatttctgataggttgatttcgactttctgatgtcataccgttggtcttggagtactgtaatgtcatgtttgtaatattagtgaagactattgccattgaatcaccatttctgtaacctaaataaaacacaccggtgttcgttttttttaaaggtgataaagcatcttcttgtagacaaaatgatagggaagtaatgtcactcctacttttgtgttttcttgagcttttggcaggagaaaagatatagggatttggaaaggtttctggaatcaaatcataaaaatgacaacgataatttacggtaataatcaacgtgtctccaacaacaagagaatcatggacttggcaattttctttgagtttgacctgacgaattttgagcagttttaaggaagaaaagtcttgtaaaaagatggcaaaagtatgcacgttagatctggtattaacgttgtgataaaaataatggctcggcccttccttgatggcaactgttctctcaagtttcattgttttgaacacatcagttggctcggacttatatttcaacataggatttaattcagccatggaaaaccccgtaaagaaattttcttcagaaaaattatccagggatgaaaatcctgcgacatagcccttgtttgttgcaaatactaatttactatgaaaacatccttcttgagttaccaataaaatacaatttgctaatactcctatctgtatcctgtgtggaaaattgagtgattttacgttagcagaactatgtgagtgatgaccttcagtgagagaatgcgatgcatactgcatatttaaaccaatcatgtacttttcatatgataaagggcgaaaagccctttccaacggattcagaagactaagcttgtacttttgtaatgtttgctgacgtttttttttaatcatagaaaattttttatcgtaattttcctcaacacattgtcgctttatattatcttttctgtactggttcgtcgttcccgtggtagaaatgctttgattttcagatatgcgaaaataacgtcgacgttctctatcataataaaaccctggtaagttaggtgtcatttgtttaacgtccgttaacttcccctttctgctttaccaactgctgcttatttattcgcccttttttgttttccattgttgttcatctcattgcctttttttatttttcagtttttcccatatgccaacgaggaaaaaagccctttcaaccataccaaaaaaaatgtatttgaagtaatgaataaagaatgatgatcgctggcgtttaacatctagcatatatctgcaataatttatcactccagaagaaacatccatcgtcaacaatttgatttaattgttctcttttgaatacatattctctctcgtacggtgggatcttgttattgcttgccattaaaaacctatattttgtctttcttctgatgatttcctgggatttctttttgtcctcgttcccttcctgagtggagggaaaatccagtcttccaaaacctgggggggattttgatctattcctcaagttatcaaacgcaaattcgtagtccgaattttgcgattctataactactgacaatgatctgtgtttagaatcctctggctttccaacttgggcataaaatcgctccaattttcttcttcctctcttaaccggggcgatatcttcatttggtctaaagtcttcgagaatccaggctcgctttgttaaagggttcgtattgaagtcaaacaggaaattatccttaacatttttgtataaatttggcgatgtagattcagggttctcgagctctattcccaatagttttcttgttttgttctctttatcattatctttttcgtggattacagtatcagagcaatcttccaaatcgcttaagttgttgaggccatttaaaggcgaactaaactccgaaattttccgtttatgcctattaggtggcatagtaaccagcggtaactgcacagtgtgtttattttcattacgatagtgaacctctgctgattctttctttatgtcctcatcaaactgagtaaggatgaaatcttcagaatcttgctcacctggccccgcagacgtctgagaggattgttgaggagcatttttttcgtgacatagaatttcagccagtttactgttaggttcttcgagaacacatttattccgattttgcagtgcttgaacacgtttcgcgattaaggtagtcacgtcatactgcacatttagtagttcatcgagactgagctccttgagaatggataagcttgactttagatacacattttcttcaccagtcaccatctcacatacaaacacctaatggcttacagcatggatggaaatgcaggtatgtgaacgataacaatgtttgcaaacgtaaacaaaaaaggtattaaagcttaaaagctttttttttgtagaacgcgcttagaaaatggcataaagaaaatggctatttgacttgattttgaaagttgttctcaagactcgaatggtggaagataacaacaggacgtttattacatggcattgcatcagtatttatcagagacttatgggcccacgaaacccaaaaataagacgaaaaagaagaagaaagagtcaaaatcagacgctaactcagacaaaacttctttgatagtaaaagaacggctaagtacactgcaacaagaacaggagaagtcaggagttgcttcattcagcaagtttgacaaacaaaaaagcaagaatatatggaagaacctggaaacaaacgagctttcccatgcaataacacatccttccgcatcgtcaattactggcaacgaaagcaagaacgatctaaaggaaatcagggctcaagagccacttgtcacagtagcagacaaatcgaaaacacgaaaaaccatatacagagacgctcaaggtcacaagattcaggaagattccaagatagacgattctagttttagtcgatctaaatatgaagatgagaaagccgcggaaagagagcaatacctgaaaaatttgaatatgggagacgtgcaaaagcttggaataaatgtagatgcacatgataagaagaaaaatcaaactgcctcgagtctgacgatagaagaccctgcaataacatttacacatgacaaagaaagaactgtaaaaacatctttactgggccgcaagctttatgataagccagcacctgagaacaggtttgccattatgcctgggtcaagatgggacggtgtccacagatcaaatggctttgaagaaaaatggtttgctaagcaaaatgagatcaatgagaagaaagtgcaaagctacaccctacaggaggattattgaaaatgagataatatataactatgcggaaagctttgtgtaaaaaataccctttgacaatccccatttgttataagctttttcttaacaagatcaacgattaaatacaaatacccctctttatataggtctcagatatactattaaagtaacctcgaatatacttcgtttttagtcgtatgttctaagtagattcgtcttttttattatcacggtcagcagcattgctttgtgactttggcgattgacattcagtagagtttgtgccagaagaaggtttaatctcgcctttcctactgttctttgtttctcccccaatagttgaaccattgctgtgctgtttaccattaatgaattttttcaaatcttggctttccttttcattgacaacaatacgacttccttgatctgaaacatttgtcataggaggtggaggtgggaaggaaatcggttgtccaaacccatgtggtgctggtggcggaatagacattccattcatattagggtaaggcatctggtgagggtgtaatgggtgaagaccattaggatgcgtcataaaacctgggggaatattgtacggcaaaccaacatctgcaacatcattcgctccaggaataggacccccaaccacattcattgggtgaggtggagttgggatattcaaattactgcctataccatcagaatattgatttgcaacggcattgaaaatagatccagcaacagttggattatcaagcggtgctttttcaaaattggccaaatcaacttgcacgttttcactgcttttctgagctggtctttttaacaaaactttctttgcgggtttggaatctttttgcgatcccatgctcttgttgtctacactttcagaattcttttcattggtatcctttttgataaaattcaataaatcatgtgccctttcttttctcagtttttcttcagattgttgctttgaaggagtcttgtgagcagttttggtattattgttcctattgttagattgctttttcttttccaaagcctttttggaagccttggagtgataaatgaactgcctgttagtaatattcaataagaaagaggcatcaagccctaagcctctattcgtgcgcaacctgccgccaaaattattaccggccacgatttcatgatcaaataagacctgaattgataatgatgaactgagagtagtatagccaacaactgtaccctttgagaaaattggtaccttaccagaatcttggatataaacaacacggtcacccaaatcgaacttttgactacgtaagagtgcaaatgatgatcttggattcaaaacagcctcacgaggaactttggctaactgttttctttcatgaccttcgatgttagctgcgtatttcatgatatgatcttccacggcagcaatcgatgtcttagttaaggagtcagactccaaagataccgcgataaacttcgatgagacatactttagccattgtttgataccatctaataaattcatggcatccttagtggaagtatcggggaaaagatcttccaaaactgggatatcattacctaccttggacaacctgaaaaaaaaatctgggaaagtttgtctatactctttcagtaaatttagagttaaatttgagtattcccagcccctagggttcctcctcgcgtaacctaaaaccttttggtgtctagcttcgaacttaaccgggataccaacattgatatgcttcccagtagcgtcagtaatcatgaacttggaagtaatcttagacaaaaacaaggggtgtaagtgcatgttcttggacacaatataagacggataatatttaacggcttgatgatccatttgtaacctttctttgccgatggtgggctcactatccaaaaacttcttttctacagtaatttttagtctgcggtcactgctgtaaccgtcaatagtagtttcaccaccataggcataatcacctaagaaaataacttttgaattcaatggaaattcctcttcaataggaatgggtcctctttctttatatctttcatcctcgttgacaacagattcaacaaccagttgcaatggatagtaatctggggtagggctaaaggtcttaatataaccaccatcagagtctctcaccaaaccagtcactggaaagacggtagcaatggcttccataggtcctattttaacagctttctgtttagcatacatccttagcattgaattcttcaaactattgaaaagttttttgtcctgggtttccgcaggcttcgttatgaatccgaactttttcttatcattggactcctgatattcatagatagtcttaccatccgttaaagagaccaatttggattctcttaaatatggccatcttgtataaatcactttgtttaaatgcctcttggaaaagtcctccaaagtaacattattcgttttgtatatgtcagttatttgtaagaccattgattgttgtttagaaggttgttggaaaaccattgtctcattgtactccagtgaactagtaaatggtaaagacaataacgtggggaaacccgccagcatttcggcaccgagtttagcattaggtaataaaccataccgaatctcggagctgtccaatgggatggtgatgtactctttttcgacacaatgattgtgttcaatatcagaaaaaatgccgcccaacggactcttataaaggttatcaacttgaggattaaaggaatatatcaagtccttgccaaattgatttctcgttttttcttcaggtgataacttgcgcaaataaggttgcatagcctcaatcaaccttttttcatctacaaacgatatcaaaaccacagcttcccaatcagctgtcttgccgtttttatcaagttgaacctcagcgggatagaaatcgtggattggcgactgttcatcgtacattaatggcctaaaggcgggaggtatcagatttttggacctttccggtaaaactgccattagttgctggaatggagtaaatggtttgctcaaatcaaattcaatgtcttgatctaaacccttggctaagtcggagattcttggtgcataatggtgcggatagtaccacgaccaagatggacatcctctataataataatatagaacccattgtaaaccttcaacgtagtctttagcaagatctctcactttttcttcactgtctgtcgtaaattttaacttgtcgtgataatactcatgcttccaacgttcaaacctttcattataaatcgttttttcagtttccaattcttctttgtcctccacgatgatagcattttgatatttttttattgttttcctgatagaattaacacgattttgaaattcttcttctgtttcatcaggattaatagaatcaagatccatttttagcgaataactacctttggatttggaatgcgttataaaaagacccaaatcaaaagcgaattcttttaaaaattctaaatgatctttcatgtctaagtccttaggtaactctaaagttggaatttcttcatctggtaaatcaggcgataatttttcctgtaattgctccatcaaccatggttttatacttccaattaatttcttctgttgttttaccagtaattttttaccaaccctctgtcttttcctttcaccctccaaagaaatattctctaattgcttgttgaaccactcaacgtctatatcatccttttcgaaatttaataactcaaattgagacagataatttaaccagacacctaatctctttaaatttattttaccatgttcattaatgtagccatcagtatgtaaaagagcttctttgaacgtttgtaacaaaacgggaaatgctcctttgttaaggtgcaaatctggcaaattgggcaagaaatcattaccaatgacgaacatgacaagaataaaatcatccaaaatacgttcaaaattgtattcaaattgcatttcatcggcaatttctttgaattccaactccatgtattctcttaataaagaaagatgtaataagtagaaattttgatgttcaagcgattttttttcactatttcttctaccaaatgtcacttcttctctcaataacgcaaaatgtggcccatgagtagacaaacccagcataatcaaatctgcgtcaagaccgtaaatacaatgtctcgtattctggttgaaatccttttgggattttaaatgccttataaagttcatgatcttgtgttcaccttcacctggaacttcatggccagaaaatatgatttgcacttccctccatttggaatcgttagaaatcttgtcgtgaataaaatattgtaagtttttggtcaatttggccataaactccgtacctggagtaatagaattcgaatcaaatggctcacccttaggaatctcgtcaccattctcaatagccttcttcaaggctttttctgcatccatagcggttctgaatctacgagctctttgttgattcatcttggcacgaggggccacaccatcaatagccatgtagaaaatcttcttgggcttgattgtttgaaaaaggtgatcgatatacgtacagatttttgcaaaaacctcttcttcagttaatcgcttggttacatcatcgtcgttaccatgcgtacaattatgtaaaatcgaattcatatccaggtataagttatcaaactcaggaatctgtgttccctcaataagctgtaaaatcatgggccatctttctgagatgtacctgaaaaattttggaatacccataccgtactgatatatatttgttgctgctgttgttacaagtgttgattttttttctccttatagtacacgaatcgtcctaggattagtcaattgcttattgtgaacccgattataagtacggaagaagacagtatcctttagaaaataaactattaacaggaacggaaataaaaggcagagagaaaatnnnnnnnnnnnnnnnnnnnnnnnnnnnnnnnnnnnnnnnnnnnnnnncggttcgcttgtgcgaacgccaaacagattttataataacggaagagctgctgaaaaaaaaagcaagctgcaactgttatatttgcgtagataaactttacaaccggtaattggaagtcgtaagtacttagtttgacgttttcagtactcgttaaactactccttaaattgctttctaacctcttcttgtttgtctctgttgttacttgctctgcggtggcgaaaagacgagcaaaggaggttgtatatatcactcaacacggaatgtattacagctttctcaaataaatgtagttgaaaaagaccattaatcgtgagaatagttactgatcaggtgatgagacgataaaaacagtaattgagagggttttcacgggtagtgggcacaatgtttggattaaataaagcatcttcgacacctgcaggtgggctctttggtcaggccagcggagctagcactggaaacgcgaatactgggttttcgtttggtgggactcaaactggacaaaacaccggcccaagtacaggtggactatttggcgctaaaccagccggatctacaggaggattaggtgcatcatttggtcagcagcaacaacaatctcagacaaatgcatttggaggaagcgccaccaccggagggggccttttcggtaacaaacctaacaatacggcgaacactgggggcgggttatttggcgctaattcgaacagtaattctggcagtttgtttggttccaacaatgcacagacgagtcgtggtttgtttggtaataataacactaataatatcaataatagtagtagtggcatgaataatgcaagcgctggactatttggctctaaacctgcaggaggcacttctttgttcggtaatacaagcacctcttcggcccctgcgcagaaccagggcatgtttggtgcaaaaccagctggtacatctctattcggcaataatgcaggtaatacgaccactggtggagggttatttggctccaaaccgacaggagcaacgtctttgtttggttcatcaaataacaacaacaataacaataatagtaacaacatcatgagtgcgtcaggcgggctatttggtaatcagcagcagcaactgcagcaacaaccacaaatgcagtgcgcattgcaaaatctatctcagctccctattaccccaatgacacggatttccgaattaccacctcaaatacgtcaagaaattgaacaactagatcaatatattcaaaaacaagtgcagatctcgcaccatttgaaggccgatacaatcgatcatgatgaattgatagattccattcctcgtgatgttgcatacctactgaagtcagaatctgcaacaagtcaatatttaaagcaagatttgaagaaaatatcctcatttaaatcgctaatcgatgaggaccttctagacacgcaaactttttcggtgctcttacagcaactattaactccgggaagcaaaatttcttctaatgacttagacaaattctttcaaaagaaaattcatctctacgagaagaagttagaggattactgccgtattctctctgatatagaaactgcggtaaatggcattgatacagatttatttggcgccccaaataaccctaattctacagctatcacagcagatctaggttcatccgaagcagagaacctactgcagttgaagacaggcttagctgccatagtctctactgtcattgaggaattcacactgtttatggatatcgctgagagaatcgccgtgttacatcaaaaaacgaaaacactggcatcattgagcatatgagtaaatcgccctgaaagtttatatagtgcgtataacaagtacaaatgtcttgtacaaatgtaatttatactaaatgcaatagaatataacatcaatcacagtttttcagtcaccataatggcgtcttagaggccgaactaacttttcttcgtgaaaaattttttgcgatgagatgggaaggaaaaaaagtaatattgacatcttcaattgagagatattacctgcaaaaaggtacatacgatagtagaagttatcgaacaggcaagccaccatggatatttttagagtattaactagaggagcttccgtgaagaaagagtcaggcccaaaggctaaggcagcagattacagcgttataaatggaaatgatgagaatcataaggaagataataatgaaagccagatcgtgaaagaacttgatttctttcgaaacaagagaatcattagcaaggtagaggatgatagagagaagacaaccgaaaacgattctccaaacaaagaggagaagagcggcaatgatgatggtctgataaaaccagtgattaccaataccgttgaggcatccgcgttgagaaaatcatataagggaaacgtgtcgggtatagatataccacttccaataggttcgtttgaagatttaatttcaaggttttcattcgataagcgtttactgaataacttgattgaaaacgggtttactgagcctaccccaattcaatgtgaatgtattcctgttgctttgaataatagagacgttttggcatgtggtcccacagggtctggtaagacgttagcattcttaattccgctggttcagcagattattgatgacaagcaaactgcagggttgaaagggttaatcatttcgcctacaaaggaattagcgaaccaaatttttattgaatgttttaagctatcttacaagatatttttggagaaaaaaaggcctctgcaagttgcactcttatctaaatctttaggcgctaaattgaaaaacaaggtagttagtgataagaaatatgatataatcatttctaccccattaagactaatcgatgttgtgaaaaacgaagctctcgatctctccaaagttaagcatttgatatttgatgaagctgataaattgtttgacaaaacattcgttgaacagagtgacgatattttgagcgcctgtagagagccatcgttgcgtaaagcgatgttttctgcgaccattccatccaatgtagaagagattgcacaaagtataatgatggatcctgttagagttattattggccacaaggaagcagcaaatacaaatattgaacaaaaattaatattttgtggtaatgaagagggtaaactaattgctattagacaactcgttcaagagggtgagttcaagccaccgatcataatatttttagagtctattacaagagcaaaagcgttatatcatgaattgatgtacgataggattaacgtagatgtgattcatgcagaaagaacagccttacaaagagacaggattattgaacgatttaaaactggtgaattatggtgtttgatctgtaccgacgttttagctcgtggtattgacttcaaaggtgtcaatctggtcatcaattatgacgttccaggatcgtctcaggcttatgttcacagaattggtagaacaggtagaggtgggcggtcaggtaaagctatcacattctatactaaacaagactcagtagctattaaaccaataataaatgtcatgaaacaaagtggttgtgaagtatctgagtggatggataaaatggctaaaatgaccagaaaggagaaagaaagtataaaaaacggtaaagcgcataaagaaagaaagcagattactactgtgcctaagatggataaggccaaaagaagacgtcaacaagaaatgattgcagcatccaaaagaagaaaaaatgaagaactttcaaaaaaacatttctcgaaataatataaacaaacgtgcgtatgcaagacatgtatatatgattagtagttttttttatttactttcattgatcaattacgtgaccagctatacatttcttcattacttcttctgggcattctatttaaatcgatatttccaaacgactttgtcattgctgcataacccttttgataactatcgtttaaccccacacctctgtaagatttcgattccactccattatgtatatttcttccagagttaaaatgctgcttgtaatctgaattttttctctggaatagaagttcattttgattttcaaatgacataaaaggttttgtttgatgtatattgttagggtggaaaaaatagggtgttccaccagttatggagttttgtagttctgctttttctccccaaaaatttgatgtattggacgtgaaatcataggtttcctcgaaagactttccgtttcttttcaatcctaatgggggagaagggcggttatctattggcaaaagtggatttctaaaatccctaatggaaggtaaattttgactttcaggttgattggagaatctacgaactgctagctctctatttagcaaagagttttcttgcatatgaaagaagtttaaatcattcaaaagttcccccaaaattttgagctcatattcttcatccaagtcaatatctctgtattccaagaatttcttttgcatttgaactgcgtcgtcaaaaaatggaacacttgacaagcaaatgtcaatctcttttttaatgtatgtaagcaagttggtttttagaaaactcacctctaattgtgttttggtaaacgctgttgtggcagctgaatactcggttggagctgaatttggcctctgtcccttgtatggtgaagtggaaatattcaattccatgaccggttcctttatttcttctaatccgcttgtaaaatgaaagggctgcatgtgtttagttttgtaaccttctgtattacaccaaaaactttcccaatttttaaattgacactctttcaagcttggactagagtccggagccagttttaagccatcattaaaatcgtccgtgtgttcagatctttcgtgtatatctttattttcatggaatatgttgcttgcagtccccattttagatgacttttcttcatctttttgggacttctgttttactggactatttcttttactttccttactagtattgccatcttcttgagaatccatgttaggatacgcaggcaaatctgaatggatgttatttggaaagttttccttttctaatccatttaaaagagtgccagctcccatcactcaaccaattcagctctttccttgccaatacaacataaccgggaagagtttcaagtttgacttccaactaaatacctaatgttttattgttgttatttatatttcttgtgacacaaaagagaacattgatgtcatttgagccttatcgttggaaaggataaataagcggtttaaaaggataaaagaagcgcaagcaacaaatctcaacacaagtgtaaaccatatgaatggggttaaatgccttcttctttgagatataaaaaggaagtagaatttaatatattagacatttttttgatttgagcctaaaaaagatagccctgtagggggctcgaacccctaaccttatgattaagagtcatacgcgctaccgattgcgccaacaaggctatttcgttgaaaaattcaggcttcaaaattattatatgtatcaaaaatatttttttgagaaatttcaaatcattatctacgctagccttactattttttcacccagaagatagtaacctcatcgcacatacctattgaagctgataatatttgaagcgagagctttattcttctcctcaaattttttttttcttctgcgctgttaacttaccactaaacctgtttccatttttaatggtagtcctgtttattattccatttttagaattgtatgtaccttggacgacattttttggcaatgacatcgaaagcactgtttgataccaagatcttaaaagttaacccgctatcaatcattttctcccctgatgcgcatatagatggttccttaccaacgataacagatcctgaaacggaagcagcgctagttgaagcggcgaggataataagagatacagatgagactgtggcttttccaaccgaaactgtttatggtcttggaggttctgctttaaatgataattcagtgcttagtatatacagggccaaaaataggcctagtgacaatcctttgattacacatgtttcatccattgatcaacttaacagaaaggtctttaatcaaccgcatctatcaggtacatccttgtttgataacataccctcaatctatcgcccattaatttcaagcctttggcctggcccattaacaattcttttgccagttccatcttcagagcatagtgcattatcaaagttaacgaccgcagatcagcctacgtttgcggtacgcatacccgctaatccagtggctagagcactgattgccctgagcgatacaccaatagctgctccttcagcgaatgcgtctactaggccatctcctactttagcgtctcatgtttatcatgatctaaaggataaaattcccataattcttgatggcggagcgtgcaaggttggtgtagaaagtactgttgttgatgggttatgtaatcctcctacgctactgcgacctggcggttttacatatgaagaaattgttaaattgggtggtgaagcttggtctctttgtaaagttgagaataagaaaacagttgaaaagggcgaaaaggtaagaacgcctggtatgaagtatagacactattccccttcagctaaagttgttttactagttcctcattgcgaaggcgatggcattcttaagggcgttgataggatggaaagattaaagaggttaatcgaaacggaattaaaagccaacagtaatataaaaaaaattgcgattttaacttccctaaaattacgtgattccgacttacaatctaagatctttaatgaacccgatttttcttcgaaaactttcatcatcgaaagacttggccaatctggtgaagaaatacagactaacttgtttgcagctttaagaaaagtggatgaaaatgataaagtagacctaatatttgtcgaaggtataaatgaggaaggagaaggattagctgttatgaacagattgcgaaaggcggctgcaaataattgtatacagttttaaataaaactgtgattaacttttgaaaatcataaccactgattacggagattttatatctagtccggaaaaagaaggaaagaataaaattttatattgctttgtatatacgaaaagtcgcccatacatgtttatcttagtatccgttgtaaatatatgtacatatatacatctacatatgttcccattaattagtacatttacctcaatagggttgggcgtcctcatgaaagataaagggaaggaaggaaaaacgataaaagcacaaaatgtgacatatcaaacatttgagaaatacgttgagtcttcttcattctttttcctcgtccacaattttctcaattcatcaacgatgaaaacgctactgctgatgagcaataacaatagtatatcagagataccaagtttctcagttttaaagatactttggaaaaatggtatatatatagcgcacatttgacctaacagagacagtccaacggcgtagttgaacattttgttcgtgaaaaagccgatttcgaagattgactttgtgttatgtctgcaggccaaagcattaaacatatcaaaaaaaacaaaacaagtaaatgtcatagtagtatctctagcagttactttaccatcttcggccatctctttaacaaaaatgtaaactgtcccaacgatgatacaggccgcggtggttagtaaacgtttcattacatcatgggtcaaaattttatcggtacgttttcttggaggttttttcataacttcatgatcaacaggttccacacctaaggattgagctggtggcccatccattaaaatatttatccaaagaatttgcattgcgttcagtggattgggtagtttaaacgctgtagatagtgcaactaatgatagtgcggcaacagaagtagacaattgaaaagtcaggaaattctgaatattattaaagatacctttaccctcttcaatggcagttaaaatagtactgaagtcatcatcagttaagaccatatctgaggcttctttggctacatctgtaccaattctacccatagaaacaccaatatctgaaagtttcaacgcaggagcgtcgttaacaccatcaccagtcattgctaccacatcacccctctttcttaatgcacgaacaatgtttaacttatgctcaggcgtagcacgagcaaaaatattaacgtggtcgatgacattggccagttgatcatctgacatttcatctaatttatcaccggataaaacggaaagctttggatcaataactggaataccaatttgttttgcaatgtttactgcggtattctcagaatcaccagtgatcataataatatggacaccaccttgtagtaattgttcgatggcaaatttaacgttcggtcttggtgggtcattcataccgattaaaccagtaaaggttaaatctttgattaggtcttcggttagaggagttgatgaatcagacaaagttagtttagcaaatccaaagacacgcaaaccttcagatgccatagaatttgcgcactcatttatcgtagctttttgggcttcagtcaacttttcagtttttttaccctttgatttcaaataacttgtggagtactcaagaattctttcaaatgcacctttaacataaactgtacacttattgtcgacagggttgagaatcttggttgccattaattttcttttcgagttaaatggaagttcctgaactttttgaacggtgtttctgatatcaggcatttcaaagtttgccaattgctctaaaagagctacatcagtaggatttcccagaaatatggcatgttcttgagagaaagatgcattattacagagattaccgatagttagagtttccctaacgtcttcagtcaaatagtttttcaaatttccattagaatttttagtcttcttatttttgtctaatgagaggacgtttagcttattggacatactgtccaagcaccaaagtttagatacggtcatgtggtttgaggttagtgtacctgttttgtcggagcagataacgttgacagagcctaaagtttcgacacttggtaaccttctcacgatggctttacgcttggccattctcagaacacccaatgccaaagtaacagtgacaataattggtaacccttctggaatagcagcaaccgctaaggataccgatatttggaacatttctaaccaagatctaccttgtatgataccaactaaacaaatcataccaataactatgaagctaaccagtgacaagtcctttcccaatttgtccattgttaactgcaatggagtcttcggtttttcaatattattcatcatttcaaaaacggcaccaaaggatgtgtttgtacctgttcctacgacgatacccttaccatgaccttccttgactaatgtacccatataagctatacaagatctctcagaaatcggtacaattgaattaggctgatcgttaaaggaagatttttcgatcgtttgtgaggttttatgtaccggttcattttcaccagttaaattactttcatcgatggataaatcgattgcttcaataattctaatgtctgcggggattctgtcacctattctgaagtgcactaaatcaccaggaaccaaggtggaagccagtacatgactctcttgaccacatctcattaagtgacattcagcaggaaccaatttattcaacgcttctagagatttttcagacctatattcttggacaaaaccgacagtgacaactatgaaaatggccagtgtgatactaacagcatcatcaatgttacccataaaaagagagaccactgcggatcctattaaaagtagaatcattcgatcctcaatgaaatttgacaagaacttcttgaaaagactttcatcatcttctacggttatttcattggggccataaagtgatctcctattgttggcctcgttagatgatcgtaaaccaccgtttttgtcagtgtccagtttttctagagcttcgtccacggataaagtacaatactctaaagaagggcttggtttcgaaagggcctctgctgtggcatctagtatttctctctcacggtttgagtcctcgtcaagaagactcgcattaaatggattgtcactcataattatcttatcttttacttacacttaagcttacgtctgtgctggccttgcttcgtcttgtcttgcccagtcgtaaggatattattatagttactagtattgttataaatgggaatggaaagaacggggcgagcaaacactattatgatggtgtagaaaaagaggtttttctattaagtgcttgaaggaagggctatagtgtacgatggcctagggaacaagatctcgatataacgataggtagggtccacactgttaacaaaaaaagtacttctttaaatagagnnnnnnnnnnnnnnnnnnnnnnnnnnnnnnnnnnnnnnnnnnnnnnnnnnnnnnnnnnnnnaaaaaaaaaaaaatgcaactagaatgtagaatacaaaagtttaacgatcggctttgctgttaagtggttatctagggatgagctgaacgtgcaattgataccaaccgatccttgctaggaacgcaactcttttcacccaccttccaccactacgatcgtgaaagaatatttgctaagaaaatcgccaaaacgaggcgaagtcgccagggtgcgcgggcacgcagggtaagagccgcaaggcctggttcggtaagtattaagctgtggacgaaatagcagtagccatggcgatgtaatttattagacggcggcttgataaaagaggactgataatcagtgtattcacagaatggtcgtaattaacggggtcaaatatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgttggcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaaacgatattgacattccattctccatcaatgagttgaacgagctatacaaacaagtatcttcgcataactcacattcacaataatgcatctggacatctatataaatatacatatacatatattggcggttgtttgttctcccggcaagctggcagtcgggccgagattcggataaatttttccattcgtatacatatacatagatatatacaattataaaatttgtccaaggctgcacaggatacgtaaccatcctaaagttttaggttttttaactttttttctgtctcttcaattgtcgaattgcttattctatcctttctggagttcgtattttcatcgttcaaatatatagataacctttcatcactcacttccaatatacttttctgatcgttactttgtaaggacgtcagccgaatgatgtactccagtagtgtgatcgacgaatccttgtcctccaatttattttcttcttcttcttcttcctttcgttcttctccgtcttttccttcctcttcgtcctcctcttcatcttcctcttcatcttcctctatcgcttcatatccgcttaccgcataccaagtaatgtcatcgagtaatcccttgtctccttcactgctctcattttctttgtcatcgctccggtcaatcttcaataccaacactggagaatcctgttcttctaatcggagaagcttaccggaaacactgaaaaacagcttcttaatatggttcagatctatggcaagttcctgtggtgtgtcttctttgtcatcatcctcatgatatctaccgtcattgaagtcttgttctattttcataaaataatcatactttctgcctgtagagttcaatctatatatccttgcttttgcacgtttcatatcctctttccaaacaattcctgattgcccattgttttctgaagttaggttatagaaaatagagaatagtgtaacctcaaatgtaggccccacttgaacttttagaatctccttgtcacctgttcctttctcattactcttcattgccttttcatactttctattgttctcgctaacgaaatcggaggcttttaataataaaccaggagaaagttgatatgggagtgcgctgttcaagttggcaccagaagtggttaaagaaagattaatgaatggagtgatttcttcgatcctcaatagcaagtcctttatatagttttctaccgctttaatagcttcattctgtgtttttgcgctcctggaaccctcaactttctgcgtcatttcgttgatcttctcatcaaacctatcaatctcttcttttaaatccttggttaacctcagagtgatttgcaaattcgtgtttcccctcgccgctaccagctttattaggtcaattgcactggatacaatagccatgcggctttccagtttaaatttcagttgatctattcttctagcatcatccttaggaatctggacgacaaagttcgttattgtctttagcgcatatgtggatgctatcgatattccggattttatagcaaatgtaacggcttgtgaacctgctttggcaagaatttcatccattctcttcagatattggtgttaggtaatagttaaagttaatccttctgagagtgtgaaactgtatcagatttttatttccctgacagcgtgagattttcttgccataatcttttttggcagtttcggctggcactttaccacgataaaactgaagataatgaaaaatttaaaagctagcacaagtataatatgacatcgctcaactttttttacccttaagttatacgattatacttttttgattgaaatacatagagatatttaccaatttggccccaattttcaattgtttattacgtctaaatatatataaccatgcccatcatttaaaataaatatgtaatgaccccccgacgatcgaattctactttttgtttttgttttataagtacatgtatgtaagagatcaatgtgaaatatattgaaatgcaaaactgatatcattgtaatgatgctcgttttttagtagatgatcatttgttttttccaatgcgtcatggttcaaatgattccaagttgtcgcatcaccatataacattgcaggggctctctttaattgtttaccctgagcattacaacgtttacaatggtatgtttcgtgtgtttcacatatcgtattctcatttttttgaaacaactgtcttaaattgtcagaactaaacaacctttcaacgtcttctttcgcatcgaccacgcatgaactcaaactcattttcatagattgtctttgaaagattttttcctctatggtaccagtcgatatgaatctgtaaatgaaacaatcctttttttgaccgtctctccaaacacgtgccaaagcttgttgatcagcagcaggattccaatccggatccatcaaaattaatcgatttgcaccaatcaaattgataccacacccacctgctttagaacttaagaggaagatgaactcttggccttcaggatcgttgaacctatccaccaatttttgtcttttgttaattgacattgtaccatccaaccgtacagcactgtagtgcttatatctacacattttttcaatgaggtccaaggtttgggtatagttggagatcaaaacaatcttatcatcggattcggtctttatcttatggagaaatctttccaaaatggaaaatttagctgaatattttgtttgtacgtccctggcttttgaacccggcatattataatcgtcaggtagttccaaatcatcttcatcgtcaaattcatcttcaaaattcaagagattagggtgattacatagcttctttaaaataccaatagccctcaggggctgagacccaccaacaccttttactacttttttcacttctcttgacttaattaatttattgtagagctcgttctgcaacggcttcaagtttacgaaaataacgtgctcatacttgcaaggcaaatatttggccaaaatatcgttagtacgacggataataaatttggagacaatggtagatagcttctgtaattgcgcctcgccctttgtgatttctttatcagtagcatcagcatcacgccctcgcaaaattggattctcaaaatttttcctaaattctgctctggaacctaataagccaggattcgaaaaactcagtagagcaaaatattcggaaagatcgttttgaatgggtgtaccagataatataactcttctaggacaactgatgctatccaaagctgtgaatgttaaagagtcaccgtttttcaaacggtgcccttcatctgccagcattaaacccacattgcagtttttcaattgatcaacatttcgacgtaatgtttcatacgatatgattaaaacgggcttaacaatatttcttccctgtgcctgagcccaggcatgaatagcttgcgaaactgttgtattaccaccacccattgaagattttttcccatcaaccgctaacggagttagagtattgggacccaaccattttatcaattcattagcccagttgttgactaaagaagatggacaaacaatgatacatttgtcgataagtcttttaccctgcgggccctgtcttaataatgtccacataagtgctatacactgcaatgtcttacccagccccatttcatcggccatgatgcagccgtaggcccctctattgttttgttcagtcttttgagattcagtaagtgccttctcgtcgctctttaagggatcttcgcttgaagtgttgaacgcctcagcttctaagtaatctttcatgacaagccctgtgacacaacggtataagaatctcaccccttcgacttgatggggtcttaaaatcttggccagttttggatcaataaccacagggacactagcaaatttcttcttgttttccgcagagttttccgaatcaccgagtagctcacgtaacggtttgtttctcacaccatttgtcatcaaagctggatggcgtcctattctttgtgtgggtctttcttcctggctattcttttccttgttaatattatccttttcctgtgtgcttttgatcattttctttgattcttcttccttgttatccatagatgtgtcatggacaatcatttcaccgtcaacggacgggtcataaagcactatggcaaattcgtctgtagggtcatgtagaggtcgaggttctggagtaattttttttttcattcctaacgttaatggcagactgtgtctttgtacatatcccttgattggcacagtgaaagatcttctcaaagtgtactggatatgactcagtcttgtcggatccttggccaacctttgagcactaagagcatccttccgtcgtttagtcaactgagaaaaacttatgtcttggctgttgtactctgcttcgtccgcatttatatccaagccggaataacatacagtcgctgatcttttcctcaagctccttcctcctacgatattatcagacccggtggcgattctaccagcagcgggcgggatgtgcgtgttcttgtacgggaccctgaacggtttcgttagtcggttcaccgagtcttgtacgttaataggcctaggtaccagtctcggccgttcaccggctcctattccatttggtggtctgtctggtaatctgcgtcttgccatcagttataaggaaatatatatggtaccttgaaatagagctaagttctgagcgtttgatttttctatactttcgtagcagctttagtgaagaaagagaaaagttgctgctctagattttgtatcggctattacgtcaagtgagaagagttttggccttcgcttcagttagatcttctattatttccttttttttctttttgtttgtaattgttttttatttttttttttgcgcgaaactttgctatattgggtaacgcgtaaaatactttttattattgcagtaaggcggaagggtcttcccctttgcatgttaaatagcatacatggcaccactcaggtccagaacgtgacacatctttgcaccacttgtgtattttcaagatgttaaatttttgatacataagctttatcatgcaggtgcagtagacgcatttgcgtacgcgttgagtagtaatgcaagaacgcaacaatttcacgctttctacttaagaggacagatcttcgagcagaatatttttctcctagcgcggctttcagaatcttcttaccatctgcaggacatcacatgcaagcacatgaagctggaaccacgcaccattaaatgtaaacctacagacatagctagcacagaaatgctactttggaaacctcggttgcatcggctgacctcggctgttcagcaacgtgagctggttgttgttattgttcatagaatcctgtattttaccagtgtagctttgtccgcccaccccacgcttttggccactagtatgtacgtatatgcgtgggctctatatcattgaaaacgaattttccacgcaaaacccacttcacaccataaaggccttatgacgatgtacattcttcccctcccccctcctcccgaaggaacccttatagtgatcctaatacggtataacgtaaaccggagttgtcagcagagagaagcgaataatatgttttgcgtggggttcccacgagcggcaggaaccgtagcgcattgaaaaatgaatcatcgatcatctttgggtttcaagggttcggacttcgccaaaggtccgaatacttccaccagtatttctctttttccctttccagtctcgttcttcgccgaatccccgctttcccatcatgatcgtttctctgtttctctctttccggaacaggctcttttctgaccgccagttcgtgcggttagttctgtggatcttgcaggcacttgccggtttagccacacttctccgctgtttgtgtcgaatttccctcgagtatgagaaagactggaccacaaaagagggaaaaaaaatgggccgattttaaaccattataggtcacagaaaaactttcttacgacggtggtttttcaacaatacgtttcttgagcaggagaggagctttgttcttttgccttagttttttttgtctttttttgtgagccatcctgctgtcgttgccatacatgacagatccacatttgccttgttgtttttagtttttgttccttgcaccatataaaagcgtcacttgtattttccttactcatctaaacttcaagctttttcgtcatagtaggtttgtgatctcggcaaagaaaaaaaatttttttgccgatctttctggttattgtttcaggtatctttatgaaagtattagtgtacgcactggatttttggtaggtctataaaagtgcaacacataatctaaatcattgaggtcatcgtatgtcaaaagaagatgtccacaagcattacagtaagaaatagagatcgatcgctaccaccgctattgctccccaatgtttccctgctagaaaaagatatacggcgtaaaggcacccaaaatgtgggcatcaccgatccagaactcttgtcgaccacttggacgaggaagcgggcttttccgactgacgagcttttaggaggctataagagattaaagcctgctgccgctgacagtaatgagtgcgctattggtattgccacggtgacgccgccgccaacgctccccgtaagtgcgattgttccccctccacaaaattacactccaccattgtttgagtatcatcctcatgctcttgcttccatggtcaatgaagacgctaatgcgtcatgcactcaaatgtctataatttcgcgctcaacgagcaactcgacaacctcctctgccacatctactagttcaatttccaagagacaaagaagtggcccaagttgtgacaaatgtcgtttgaaaaaaataaaatgtaatgcgaaaattgagattttgcttcaagacgatactataatgccaatgatctcgaacaagttgcggtacgtcttgactcctgacgatattcggctatatcgaggcacgctgttgcggaatattgccataccggatgatgtcattgagggtacaggctcacgcaagttgattaagcatattgataagttggttttgctcacaccttgtttaccatgcattaagaaaaagcattcttcttcttccactaatttcccaaaaaatgataaatgtactttttcaaaaggctttaccagagctgacataaacatttcatccaaaatctccttaaaatttaaggataaaaccatttacgacataacctatgatgactataaaagcattgatttttagacaaaggcatctctaatgaatagcatcacaaaacttgcatttagcattaacatatatggatatatatgtacacacagaaaacgtataaacactcatgtataaccctacataataagagtatacaatgatactagtcataaaaagtattgtgtgtatagacgtgcgcatattttcaaaatattataaacctgaacaatagacagaataaagtatgcagcgcaacgacaacgatgatggacagcgaaaatttcccgttcgattgtgtctccgtattattattactcgatatttgagaattcaagaaataagacgactgtgcccacccaagagccacaattgcccattgaattgcttgaacagtcctcaggcgcttggacatatccaatatattcaatataacacaaacgggtatccagatcaagttagcgtacccgtaaacggaaatcaattcaggaacacttttgaagcttctattgcgctccgagtgctcatctctattcaatacttgcatggtaataaatggtacgccgaacgtgtacccgtaaaatagccaaatagaatgcagtagcttcttaaactgactggccctgtcgatgtcctcaccagtcttgacgccctcaattacgtcactgataataaaatttaaccccctactcatggtaaaattgatcattaccaccgtggcagtgatccatacagcaccgtataaatcagtgttatcttcgttactttcggaattatgatcgtttctaaacgtcagtaccgcggacaatctctttttgaactgcgtcaaatcgatctggaagtatttagaatagtagtttatcaatcctggcctcaatccattacgcccaagaccgtcgttgtcattctgtcctatcacttggtcgtacgctggtgggtccatttgaccctgtaatggtgcggattctgccttactgcccgttgtgttataaaattcgctaccctttccagcagtcgagttattcatgtttgggctatcaggtacggtggcatcatcaaatgggttgggctcgttgccaaaatcatctacaccctcgagatcatcgtcaatatctaaaaaactgctattattggacggcatttttctgcttttgtcgagtcaatcctatttgctagtatacaatcgtggatgaagcgtaaaaaagaactacagaaccaatgcgtttggatccaatgtggtcgctgcccttggccccttttaccttgagcgtaggacgttgatacattttcactgcttgagaaattaggtataatacacagccgggtaaatagcgtttaattgatcgctgctccgtaataccgatatactgttacgttatgtattgaaaatacagtttaactattatttgtagggatactactatggggtctcaaccgcacttaaaggcgctaaaatattttgacttttccttccttatattgtagacgtgttatttaaaaactacattttccatatctcgtcgccagaaacttctaatttggtaagccttccaataaatatgaaagaatcccctctcataacgttggttaaaagacattccgagacacattttgccaatatcaagtatgggtattatgtgttgataatatcattggtctatctcattggattggctcttttgagagctttcggaaggagaaccccatccagatcgtcgtcagctttcaaaaataagataatttatcggttgtatgatatagatcctgcaattcacttaggtatattgttttttgcagtcttgattccattttattaccattactctttgactacccaatctacggtctatctcaaaagattagggaggttgagttacgccttgatcccgctgaacctattcctcactttaaggcctaattggttccttaggaaaaattgcacctacactgattttataccgttccataaatggttttcacgtattatcaccgtgattggtttgcttcatgggattttcttcatcattaagtgggcgatagacgataatgtctctctaaagcaaaaattgattctgaaaactttcaattttgcgggattcataatatcaatattggtactttttttacttatttgctcgattgggccaatgagaagatacaactatcgtttgttttacatcgtacataacctggtgaacgtggccttcatcttactcaccccaatacactctaggccaggtgttaagttcccatttcttctactaaactgtaccctattattcattcatattatcaatagaatagtatttgcgaaatccttgatgattttgaataagaatgcgaattattcaaaaacaaatttagtccatgtaagattgcccagggctattcttccagattattttgaaccagggtcgcatattagaataagcccttacagaagaattaatcccctctattggttgctaccatcgcatccatacacaattgcgtctttggcagaagacaattcaattgatcttattataaaggaaacctctacagccgagccaggtagccagatagagtctcttcgtagtaatccaaaatcctttcatttagatcaagaaaaaacctatactttgattaatagttatcctccctctgtacccgaagaatgttattctcaaggcacgaatatagctattatatgtggtgggtctggtatatcttttgccctaccactatttaggcatttttttaacaaggagaatgtaaaatacttgaaaatgatctggctgataaaagattactctgaatatgaacttgttttggattatctcaagacaaatgggttgacttttgagaaaaaactctcgaataataagaggatttcagtatttattagtggagaatacacggcggaaacacggttagacgaaattacgaccaatatcgacgatgaaaactcagaatatgaaatgggatctttcaacaatgaagacgaagacctttcgatttctaatttcaattcagaaaatgcggacagcaatgacaatacgccagagacaagtcatagccccacaaaagagaatggaagcatgatcgaggtaaaatccaaacacagttttactctttccaacgaattgaagagcttcaacaatgaaagtgcacaagtgaaccaaaatgaaacatggttgttttcatgtggtcctccctcgttattacaattgtctaaaaaatattgtaacgatgaaaggatcaactttgtctgtgagacttacggattatgaggggaaaagaaaagaataataatgtcttacgcaatatgctcggaaatgatattccacgacattagatgctaatttatagtatatagaaaacaaaaaatacatatctgttttttaatgacctttagtttatatgctttcttgcgcggctattagaatacacttgacaggttgtacgcattattaatcggtaaatggagatatattagagatgatcgttttaaaatggaggctgtctgcaaaaaaattgggagctacattagcaaaaagcttcttttcttgttgttctcggtttatatttcaagagggcagtaggaaaaaggatcgaaaagctcggcctgtggccatgtcctctaaaaatcaaatataatttactggccaacgttatcggctctttttgatatctatcatctctttagctattgttatctggcaactgattcaactgatatgaacaattccataattactgatgatgaggttagagagttttacttaaactgctcttctcaaacaattattgaatctcttctcagcttgcacgagtcattgagattatattctcaaaaccatgagatactgctcaataggatgttcaaaaaattggatgaaaccaatgcagactctaacatatcccatatattcatgcctgttgtgagcaaggatttttcaggaataaaaattcttgtgaataacaacaacaaaaattttcaaggtgtgataaatgttattgagcctgaaacaggaaaattaatcggatgttttgaggctaaacaaattaccgctataagaactgcccttgcatcgtgtatcggtttatataagcaactctcatgttcccatgataagttgtttagatttgaaaatggcacttgctatttaacatgttttggtaccggtctccaagcattttggcacatatacatagctattaaactaatcatgtcagggattgttggcgaatctttgaagttagttgaaataaacatactatatcacaataacatgatgagtttggatcgtttgaaatcattgaaaaacttatttggaagtaatataaagatagagcttaatcagtatcaaataaacgacatcagttcagaaggtaatggcgctgtttctaacagtgatattatctttggttgtctacctactctagagcccaacttgtttttgaggcagttgctaaacagtaaagcttctgtggagcagaaacatacttatatctcattaattggaagttacaaaccagtgatgcacgaatgcgataaggagttgattgataagttcaaatctgataatgaaagcgcttgcattttggtagattcaagggaacatactttattggaatctggagaattaatcgattccaatatcgctccacataatctcatcgaaattggtgaattagatactttgaaaaacacagttttgaatttgaacgaaaagggctgcaaaagaactatcaccttgtgtaaaattgttggtctagcggttatggacgtggcgcttgctaaggaattcttaagcttgagaacaaaaaacacagaaaacaaggaataaattgcatcttggcttctagtttttttatattcaaaagggttcttaagtgtttttaaatatgatactttttttaatatcttacgatccggaagagatttttgatgtttacatatgagcagtttgatagaaattttgcaattttttatatttattaaaagaataaaagtaaagtgcagaaagaaaacaacatcataaaatatgaaagaaaaaaaaaggcaatgttagtgttatgaagggagaaacaattaccgtatactgtttgcaggtgtctatcctccacggtatagcacgttaggaccatttattcgcgctacggatatagagtttaaaatgacttaattacatgaataataccataattcttataaccgtcatcaatctaacgaaagctaggagcaattttcaacatgtatttcaagaaattagcaatagaaaaagaattgaacagatatgaagatttttgccatattttaaagagaggctggtgacttttctctgtcgatctgtgcatagccaatattaaagttatttttcattaacgcgcatatggaaaatagacaaatgtcatagggttatagttcttagatttactattctctatttgatgtcggcgaaacaatgttcctgttttttaaccatatttatgttccacctcgatagccgctgattattaaaaagatgtaggcttgtatggaaattttcgagactccatttttggacgaaagcaatgaaaattatatacagaatattccagaagatcacctcaaaaatccaaaaatatgatcagtgatttaacaagaaaaccgaagatttctattgttccttcgaaattttttcagttttatgttcaatctctatgtttttcttaaaatgataaaaggtcgtccagcttggtgaagcttacatttaaattaaataaattggtgtgactgaatagaatagcgtccttaataactagagattacattgtagatgaataacaactaattaattcaaaaaaagtaatcgttaactatttccggaagaaacaaaggctcattatcaaatttgatgatcacaaccaatgtgtatttaaataaaggccaatatctcacggtctgttgaatctaaactaactattgaaatattcatttgttcagaaaaaaagatcattaatattacatgtactgatatgctaacaatccaaaaatgcttatactacatattgttgtacaccatgggtaccgttaaatgacagtgtaaacaattgcagaaggaaatgttacactagcggttaaacaatactgaattaaagattttttagttgaatatgatatgacagttatatacgtgagcaatataagtccccacattgagtgtatgataactaccggaattactatcatattgttcgtaagcaataataaatcaattagtgtgggtgttttatacctctctcatatgagtatataaagatccttatttaattttgattatactatcttctagccttcaattatcgacatcgctcacttgagcagttcatctaagaaaaaaagaactatagctaaataacccagtattatttgtttcgctgtaggttgttgcacaagggtttcttctgtgaacattttgaattgtacgcttaagatgataatacctaactgattccaacctatattagtagaaccgaaacatacaaataagtggttgtttggccgagcggtctaaggcgcctgattcaagaaatatcttgaccgcagttaactgtgggaatactcaggtatcgtaagatgcaagagttcgaatctcttagcaaccattattttttatctttttggttctgtgatcaagctacccgcgtttgaagccgactaaagacgagaaaaattagaccttcatttttgcctgtttgctgcatgtaaaagaatgttggttgaacatgtcgtttaagagaagaaatcgggtacggcgctctggcttttaaaattgaagaaattggtgttcttccggttaatactttgaactcggcttttcttaacatgtaataaagtttgttacatctcccataattaagtttctggaacacgcattgttctatttttagacgggagaccagaacttcctgatatatgaccgctttttagtgactacgtatactttctttctgcaattacgtgtaagaaaaaattgattttttatttttaaattcacggaatttcagactgtgaaaactttgtagttccaactcactttgctatgcaagaaaataatgaggggaaacaaaaaaaaaatgagagcggagaaaagaacaatgcagctcaagtatgaagaagaaagtcacagcaacggaaataaaaatcaaaattgcgaaaattgacaatcttgacaatcgaagcggaaaaacaatggaaggtccagatacctgttgaccttaaaaatgcagaaaaatcgcctttatacggcgacattgtgaaaaatgacgttaaaatcttgtacataaaaaaagggaattacaaacttgtagtgttttttttttttaggggacttgcatgaaagttaaattttatagaagtaattaaatagtcgatttcctttcctgtgtgtgacgaatctagatttttttcatgtaagagaccccgccctgcggagaggggcaaacaattctagcagaaaaaaatcagtggaaaaaaaaaagaaattccggatatgatagaatatttcttcgagaaaccttttggatgaggagtgcccttccatgaagaaattcttcctgcatcagcaccttcccggcaaggcatttcattttttttttccgagaagaagatttttaagtgggctaccccacgctttcggtgcctatggtagctgcatgatcacacaatgcactcccattaagagtttgtgaagtgcatgagattgacatctcggcgtcccttagtttcctgtcggattttcagttatatggagtgggtgaagtcattatccgaatattcgcggatcattgacgtataaatacttcatactacttcataccagatatttcctacatgttgaaagtcaattgaaaaaaataaatcatcacttaactcttttccagtgacacatcgcaaagattactcaaataatcttcctaaaacaatactaccagcatctatttcatgcagcaccaagcacagaggctacatatcatataaaataagtcatcatagagaaaaaaatgtcagtaaacccagaatttatagccgatggcatcgatttttatccaacaacgcccgatgccgcgtatttcaatgccgctgatggtaaaaataaagttaacaggataaatggtaactcagaaaatttacaccactcctttgcatcgggttgccgtagatcatctctttcagtcgactttaatgttacctcgtccgattcagaaaaaagtgaacagagctgcttggaaaacaactctcaagaagacgaatatttttgtgacattttttccactgaattaaaattagatgaaacttctaacaagtcaaccgattattccagttcaaatcaccagtatcctgaacaactggagttgcacaattataaactgctcaataaaattggtgaaggggcattttccagagtatttaaagcagtaggcatcaacacggatgaccaagctcctgttgccatcaaagcaatcataaagaaaggcatttcgagcgatgccatcttaaaagggaatgatagaatccaaggttccagcagaaagaaagtcttaaacgaagttgccatccacaaactggtttcgaaaaataatccgcattgtacaaaatttatcgcattccaggaatcggcgaactactattacttagtgacggagttagtcacaggtggggaaatatttgataggatcgtccaactaacatgctttagtgaagacttagctcgtcatgtcattactcaggtagcaattgcaattaaacatatgcactacatgggtattgtgcatcgtgatgtcaaaccagaaaacctactatttgaacctatcccattttatggccttgatggggacatgcaaaaagaagacgagtttacattaggtgtcggcggaggcggtattggtttagtgaagctaatggacttcggactagccaagaaacttcggaacaataccgcaaaaactccctgcggaacgatagaatacgtcgcatcagaagtattcacctccaaacgatattccatgaaagttgatatgtggagtattggctgcgtactattcacgttattgtgtggatatcctccgttttacgaaaagaacgaaaaaacattattgaagaaaatatcgagaggagattacgaattcttggcgccatggtgggacaacataagttctggcgctaagaacgcagttacccatcttttggaggttgacccaaacaagagatacgatatcgatgacttcctaaatgatccttggttaaattcgtacgattgtttgaaggattcaaactcaaattcttatgccagcgtgcaaagcatactaaatgattcattcgatgagagagcagagaccctacattgtgcattaagctgccaatctgaaaaacaagatgacaccgagttttccagaagtgaaagctcggaatacatatttatgacggaagaagacagaaacctacggggcagttggatcggtgagccaaaagagtgttttaccttagaccttgcaacatcttctatataccgaagaaggaagaacaagatattcttctggtaaactcttatccagtggaaaacgcacccagcatattcgaaaatatatcaactgtctcccctttttatactaataattaatagcattcatattgaaataataaaaaagatacgtttaatatttacgccagctctctagttacagtttcctaacgcatacgtcatcaatttgttaagatcggcttcgctctataaaaatgtcggccgaaattagcataggattttccgcggttccgacccctatcctagaaacacggaaaaacttgcgaataattccggaatttattctatgcaactttatgaagacaaattactataaatgaaccgctcattcagaaaaactatgtctcgagctcaatggatcttactacatagtttataaaaacagtaattgtgcattgtacaactgtgctaaacagacttaaaaaagtaataattatgactactgataccactgttttcgtttctggcgcaaccggtttcattgctctacacattatgaacgatctgttgaaagctggctatacagtcatcggctcaggtagatctcaagaaaaaaatgatggcttgctcaaaaaatttaataacaatcccaaactatcgatggaaattgtggaagatattgctgctccaaacgcctttgatgaagttttcaaaaaacatggtaaggaaattaagattgtgctacacactgcctccccattccattttgaaactaccaattttgaaaaggatttactaacccctgcagtgaacggtacaaaatctatcttggaagcgattaaaaaatatgctgcagacactgttgaaaaagttattgttacttcgtctactgctgctctggtgacacctacagacatgaacaaaggagatttggtgatcacggaggagagttggaataaggatacatgggacagttgtcaagccaacgccgttgccgcatattgtggctcgaaaaagtttgctgaaaaaactgcttgggaatttcttaaagaaaacaagtctagtgtcaaattcacactatccactatcaatccgggattcgtttttggtcctcaaatgtttgcagattcgctaaaacatggcataaatacctcctcagggatcgtatctgagttaattcattccaaggtaggtggagaattttataattactgtggcccatttattgacgtgcgtgacgtttctaaagcccacctagttgcaattgaaaaaccagaatgtaccggccaaagattagtattgagtgaaggtttattctgctgtcaagaaatcgttgacatcttgaacgaggaattccctcaattaaagggcaagatagctacaggtgaacctgcgaccggtccaagctttttagaaaaaaactcttgcaagtttgacaattctaagacaaaaaaactactgggattccagttttacaatttaaaggattgcatagttgacaccgcggcgcaaatgttagaagttcaaaatgaagcctaagtatcacgctaattgaagttttttttgatcactccaataggcaaatctatagatatataaaaaatatagacaagacttttttttacattgccagttttcttttttcctttttagtatctattcaaatgggcgaccctattgtctaatttcattagcttcatcacaaaaagtgccacgaattcatatagcgcgagggtaatccctaccctaactcgtttaagggagacatagaatgaactccgccatcatgtgctcaagactagacgaagctatattagaaggacaggaggaggttttattttaaccagttacttcatttctaatatagagattaaggctgcaaaagagtttcaaaaataattaattatgtcatctgaggatatcatttatgatcctcagttcaaacctgttcagggaatctacgagaatagattaagacaatttattgatactggtggggattaccatgacttaaatttacccaagttttatgataagaagcgcatttcattagatcatgatcacgttaaggtttggtggtaccaggtttcttttgaacgtggatcttcccctgtttcccctgataagaggccatcttggaaatctattattgaacgtgacaagaagggtgaattggagtttagagaagcgaacataaatcagccctttggacccagttggtctaccacttggttcaaggtgaaaatctctttgcctgaagattgggttaaatcaaacgagcaactacttttccaatgggattgttctaacgaaggaattgtcatagacccaaagactctaatccctgtgactgctttttcaggtggtgaaaggactgaatatgttttaccgaaaacatcggatgggaaacatttcttttacatcgaagctggtaataatggtatgtttggctgcggtgcaggatccactataaatccaccagatgataatagattttttcatttgagaaaagctgatatcgtttggcccgatctagatgctcgtgcattgtatatcgatttttggatgctaggggatgctgcaagagagctacctggagactcctggcaaaaacaccaggcaagacaactaggcaatgcagttatgaatctttttgacccgaatgatcgttcaagtgttcgtaaatgtcgtgaattactacaaagggaatactttgactcctttttagaaagcagtaaggtttacgaacaaggtgaatctcaagttttaacaaatgtttatggtatcggcaactgtcatatagatacagcttggctatggccattcgcagaaacaagaaggaaaattgtgagatcttggtcttcccaatgtactttaatggatcgcttcccagagtataaatttgttgcttcacaagcccaacaatttaaatggttattagaagatcatcccgaatttttcaataaagtgttaattccaaaaattcagcaatctcagttttttgctgttggtggtacatgggttgagaatgataccaatattccctcaggggaatcgctggcaaggcaattcttttttggtcaaaggtttttcttgaagcattttggtctcaagtcaaagatattttggttacctgacacctttggttattcttcgcaaatgccacaactttgccgcttatctggtattgataaatttttgactcaaaagctttcctggaataacatcaacagttttccgcatagcacgtttaactgggcagggattgacggttctcaattattgactcacatgcctcctggtaatacgtatacagcagattcacacttcggtgatgttttgtgtactgccaagcagaataagacaccagaatattacggctccggtttaatgttgtacggaaagggtgatggtggtggaggaccaactgaggaaatgctgcaaaaaatgaggcgtattagatccatgaataacagaaatggtaatgttattccaaagttacaagttggtataacggttgatgaattttatgatgacattttgaaaaggactaaccaaggccatgatttacccacatggagtggtgaattgtatttcgaatttcatagggggacatacaccagtcaagctcagaccaaaaaattaatgaggttgtccgaaattaaactacatgatttggaatggatagctgccaaaacatcagttttatatcccgattcgtataaatacccttccaaacagattaacgaactttgggagaatgttttgttatgtcaatttcacgatgttctaccaggatcatgtattgaaatggtatataagtatgaggctgtccctatgttgcacaacgttgtgaaagaatgtacttccttaatagacaaaaccgttcaatttcttcagagtcagagtaaggcagatttggttgagatgagaacattaacttggtcaaaaccagaaaaggtttctgaggagtgctcgttgaacggtagttacacgtcctctgtaaccgggtacgatgactatatagtccttgccaatgggaagttgaaagttatcatttgcaaaaagactggggtgatcacaagcattacggatgaaactttgggggtagaatacctggacacggaacatggcagaaacaaattgggcgccaaccagtttgttatttatgatgataaacctttgggctggcaggcttgggatactgaactttattccgtcaaccaatacaagtatgtaacaaagccgaagaaagttcaagtttcctgcaacacaaaagagaaatgtgctgttgaggtcatttttcaaatttccgaaaaatgcaaaatcaaatcagtgatatcactcaatgcaactgcggtcactgatgctaaattaagtaaagtagacatttctacgacggtagaaaactgggatgctagaaacaaatttttaaaagttgaatttcccgttaatattcggaacgattttgcttcgtatgaaactcaattcgggattaccaaaagaccaacacattataatacctcatgggacgtcgctaaatttgaggtttgccatcacaaatttgctgattattctgaatacagcaagggtgtttcaattttgaacgattgcaaatatgggttttccacacacggtaacttgatgagattatcattattaaggtcaccaaaggctccggatgcgcatgctgatatgggtactcatgagataaaatatgctatctatccacatagaggagcactatcaagcgacactgttaagctcgctcacgaattcaattattgcttcaaatacaaactccccaaagatattggcatgaattttgatgacatcataagcatttccggagatgagaatgtcattttgtctaacataaaaagaggcgaagatgatagtgctgtcaagtccaactattcattaaatccaagggatgaacaaagtattgtggtaagggtttacgaatctcttggcggggaatcttttgcttcactaaataccacactaaatttgaagcgtattgagaaggtcgataacttggagatgaaagtttataagagtttgacagcaacgcgagacgaatcaaatcatgcaataaacagaattcccattaaattgagaccttttgagattgcctcattcaggttgtatttctgagtttgtctccctcactgttttttacattcactcactcccaaacttatgccatttctatcatgataaccaaaaatagtcttaacaaaatacatataagtaaataatgctaaataaaaaagcaaaaaaataaaatttatatcacacttgtaaaacctttaaatgatcttcttttttacctgttttattcacttgtttttttttttctgagttgttgcgccttggaagaatggaaaagcaatagtttcagtgactatagtatacaatcaaaacacccgccagttcaaaactattacttggtcactaacccccaagtcatctctagcaatttaaatttcaattttaagaaaacctttatttatccaacgtgaacaagtactttcaagcacttctgcccaccgctatatcgtggaaaaatgtgtcaagctaccaatggcccgagtagagttgtgactaaaaagcataggaaatttttcgaaagacatctacagttgcttccctcttcacatcagggacatgacgtgaacagaatggcgataatattctactcaatctcaggactctctatatttgatgttaacgtttctgcgaagtacggcgatcatcttggctggatgcgcaaacattatatcaaaacagtgctggatgatacagaaaatactgtgatatctggatttgttggaagcttagtcatgaatatccctcacgcaacaacgattaatctaccaaatactctctttgcattgttgtccatgattatgctgagagattacgagtattttgagactatactagacaaaagaagcctggcgagatttgtttctaagtgccaacgacctgaccgtggctcgtttgtatcttgtttagactataagacaaattgtggatcttcggttgattcagacgatttaaggttttgctacatcgcagttgccattctgtacatatgcggatgccgatccaaagaagactttgatgaatacattgatactgagaagttgcttggctatataatgtcgcaacaatgctacaacggagctttcggtgcccacaatgaaccacactcagggtacacatcttgtgcgctgtctaccttagctttactctctagtttggaaaagctatcagacaagtttaaagaagacaccataacctggctattacataggcaagtatcaagccatggatgtatgaaatttgaaagcgaattgaatgccagctatgatcaatctgatgatggcggtttccagggaagggagaacaagttcgctgatacgtgttacgcattttggtgcttaaattcactacacttactaacaaaggattggaaaatgctatgccaaactgaactagtcacaaattatttgcttgatcgaacgcaaaaaacattaactggaggctttagtaaaaatgacgaagaagatgctgatttatatcacagctgtctagggagcgctgcgttagcattaattgaggggaaatttaatggagaattatgcatacctcaagaaatatttaatgattttagtaaaaggtgctgtttttgaagttcaaacagtaataagagtctatcgattacataaatgtgagcaagcgaaaaaaaaaaattggcattataaaccatcattttcgatgaaataatcaatcaacgtagataagctgatattatataattttggtctgttcgtgttgattttatcactgatggactttggcatacagatagtgacaatttcgttattgaaccattgagaatggaaaatcaatggaacttcatccagagttatgcacatagaagctccctcagccggaaaaaagctgatagcgccaaaatctattagtgacaagtctgtgttaaggccagttccagtaaattttgtatacgactccttcaaggaccataagtaagtaaatattgtgcatggatcagacgctttcagtaaaccgttaaattctctttcactaaaaacttctttaaatagctccaactcttccctcccgccataattgcacggagaagcgatatcaattccgacatcctggtattcatctgtacttacacattttacgaggaacatagctacatattgttcaccgatggtcatgctaaatggaagaaaacgattgttgtctaagaatggcttaccgaagctgcccttgtcaaatttcagctcttgaaaatttaagcccgttactatagagcagccaaacaactgcagcagctggctgcatagatttgaacatctatcgtgaaacgattttttattgaggattctggcttgagacgccaatggcaaagttctcattaatgcctcgaacgtaaactcatccgcgagtatatcctcttgaatttcaacaacgaatatacctgcccatggtcttacacctgccacctttgaaacttcgcttactacttcagtcgttttaaccatccacggtttttttgctgagtgattctctttctcctcattctcattttagtcatagcggttttaataagcgcccgaaagataattgtaaaacatatattcaatgcttaaaaatataagaaattgcccatcaatttgaaaactcaagtaaaacagagaagttgtaaggtgaataaggaatgagtgacgtggtcagtaaagatcgtaaggcattgttcgactcagcagtatcctttttaaaggatgagtccattaaagatgctccacttttaaagaaaatcgaatttttaaaatccaaagggttaacagaaaaggagattgaaatagccatgaaagagcccaagaaagacggtatcgtaggcgatgaagtatcgaaaaaaattggtagtactgagaatagagcctcacaggatatgtatctctatgaagcgatgccaccaacgctgccccacagggattggaaggactattttgtgatggctactgccacagctgggctgttgtatggtgcatatgaagtaactagaaggtatgtgataccaaatattttaccagaagcaaaaagcaagttggaaggggacaaaaaagaaattgatgatcagttctccaaaatcgatacagtcctcaatgccatcgaagcggagcaagctgagtttaggaaaaaggaaagcgaaacattaaaggaacttagtgacacgattgctgaactgaaacaggcgcttgtgcagacaacaagaagcagggaaaagatcgaagacgagtttagaatagttaaactcgaggtggtcaatatgcaaaatacgatcgacaaatttgtttcagataatgacggcatgcaagagttaaataatatccaaaaagaaatggaatctctgaaaagcttaatgaataaccgtatggaatccggtaatgcgcaggacaacagattattttccatatctcctaatggtatacctggcatagatacgattccatctgcgtctgagattcttgccaaaatgggcatgcaagaagaaagtgataaagaaaaggaaaacggcagcgatgctaataaagatgacaatgctgttccagcgtggaaaaaagcaagagaacaaactattgatagcaacgcctccattccagaatggcaaaaaaataccgccgccaatgagatcagtgtccctgactggcaaaatggacaggtcgaagactccatcccatagcgcaattctatgtaagtaattagttttttaacggaaattgtaattgtaactgtcctagatactatggacattcaatctgattgttacccggaacatttgcttttgaaaggcatttttagtagcactaatatattggcagctaattgaaacagtaatctacaaatatgagtaagctaaaccacctcaacaaagctattcgtggctagtatatgaccttgaattgccatggaaaaagaatcagtatacaacttagcactaaaatgtgctgagcggcaattgacctccatggaattttcgaacctttacaaggaattctttaatgaaaagttcccgtctttgattcaagaggaagaagaagatacaacaacaactgcaaatataaatgaggtcaagaaagcgtccgatttggtggatacacccagcaacaacacggctgctactgcagatactacacacttacacgaggctctagatattgtttgctccgattttgttaaaatattaaacctggagaagcctcttatcttggcagattatatcgttgaggtattgcttgtgaactacaactcagatatgataaaatgctttctgcctaaattgaattccgttaggaactccttgctattggcccattttttctccaaatcttgttcattctttgccaaattatcagatactttgataattgatcaagtacgcaaggatttgggcaacgtcatagtaccgaatatcttaagtctagacatgaatagtatgaataaagaattgattgccatagtatcaaagcttttgcaaacaactttaaaactctctccttcaccaattcttttaacttctgccggctgtaaaaatgggtcttttacgctactaaatcagttgtctcaaaccaacaagttactttttaaaagggtttctcagacttttgaagcaaaattacatttcaaagataccaagccatttttaaacaaagattccactaacgaattcgtaggttctccttcattaacctcccctcaatatatcccaagtccactttcttcaacaaaacctccaggatcagtcaattctgctgccaaatacaaagacatgaagcttcttcgttactataaaaacatttggctgaacaataaaattatcaattgggaaatatcgaacccagacttcctatcaaaatattctgcgattacttcttctatatttcaagagagctttaattcagttcaaaacttggaccagttactcacagacttgattgagacatcgtttacttgttttgctcaattcgttagcaataagcaatatcatcaggcaaattctaatttgactctgttagaaagaaagtgggtcatatttataacaaaacatctaccattattaatcctggaaaactcttcaagaagtcctcgtgtaatcacgaatgctctggataatattgacgaaaaagtcgttaaagcaatcagaatatacttcaccgaaaaagatgataacaaaaccaataatgaagatctatttgatgattatccatctacaagcttggatataagacacgattttatcaaagggttgattatgttaaatttacagcctgcgtccgttatcaacaattacttaagagaggaccaaatgatcgacaccagtattttacctacccgtgatgatttgtttgttcgtaatttgcaaggcattcaagaagtcgtccataataccaacagtttcatcatttcatccttagatactttagagttagaatcgataaccgaatcgatcacacatgattcgagtaacggactatttcaagtattacacaattttgaatctgtagctccgacaaaacaacgtgagatagtaaaagcctttttatctatatttgaagatgcaataaaagaattgaattataatagaatagccaagatatgtgctcttttgtttttcaacttttcacattcattgaccacaattctatcattttcttcgccagcagcactaatgaaaacattgataaaattcgttgatttgtctagaaatggcagaaatggctcaaacggtaatgatgaaagttcagaatatgaaacgataaatatatctttgtcattttcttgggcaattttactgataatcaacctaacacaaacatatggcatatctgtggtggatgtggcacttaagtatcctgaattgagcataaaaaattcctttataatcaatttcatttcaaatctacctaatgtctcagataagtactatttggaagaatcaaatgtgaatgattcagatatgctaacaaagtctcataataccgttcaaagctggctttgtgatctttttgttaatgggtccataacagatcaattgatccaaaatattgaaacaaggcaattggctaatctcataccatttattgttaaacaggttttgctatctgttgaaataggcgttttaacggatatttcaagtctgataggtggcttcgaatatttcttacaacctttactattagttgggctaatcaaaactttttattggctagaacaatttctttcttgcgtcaagaacgacacaatatctgaagatattttacaagggatattcaatttattgaatacacttttcaacccagtaactcttaacgaggattcgaaagcgttccacacggctgtactgaggttgaatgcaattccactactcaaagttctccgcaaatttagagttcagagccagtcaaattatggtatctactcttctgatgcccaaggtgatcctaacttagaacctttgatagccaaattagttgccgttcttaatgtatcacccgtttatgacgtcgatccaagaattatcaattcagagaacgattattctagaaagcagttgggttacggtaaattcctaattttgaacgaaaacccgattaacaagataatgacgaaccaaattaactcattctggagtctccacagcagcacatattataacttagattatctatttgagttaattgaattggttaccccaaaaagtttcctttttgatgttttgaaaacattagaatataaactagccacttatggggtccctggttctgaaaataagaggggatcattggattcagagcatgttttcgattatttcttctactttcttgtactatatgatgtgaaaaccgcggaggaagccagtcaactaatagaatatatggagaacgacgcaaaaaaaagtaagggggacgttgatataaagggagaagacttacatgagaaaaatgactcagctgaggtgaggcaagaaactcaaccaaaagctgaagctacccaagacgatgatttcgatatgctttttggcgagaatgatacaagcactcaagcttacgaagaagaagaagagaatgaggataacgacggcaataatagaacaaacaatgtaccaatgataaaagcagaagaaactcctagtaaaactaataagatatccattttaaagagacattcgtttgcggtacttctgcatgaaagaaaattattgaatgatttagctttggaaaacggcgaaataaccaagacagaaaatgagaaatttatcagttatcacgataagtacttgtgtatgctgaaaacatgcgtattctgagccatctctcctgatatataagacagatattaataaaggtgatatgatatagatatataaaaacactaaaaaattaggcagtatgataacgaatatctaatatgaaaaaaagatgaagatagcagattaaagatagacattaactccgcttaatgtaaataacacaatatgaatacctttttcatgccaatgcacttgccgcttccttaattccatcttgacttatgcttttgctaccttcacgagtgacttcggaatcattttcacccacttcaatggttttaatgtttttttcctgagtcttaccttccatgacgacttgttgaacttgctctttttgctttgctctatccctcattctttcttcgatggtaccacgaacaagtaatctgtacactgtgacttgcctcgtttggcccaacctatgtgccctatccatagcctgtgaatcaatagtagggttccaatctgaatcatagaatataacagtgtcagctgcggtcaggttgatacctagaccacctgctcttgtacttaggaggaaaacaaagatttctggattagtctgccaatcatggaccaaatctcgacggtcctccaactttgaggaaccatccagtctaatatgattatattgtctataggtcaagtattcttccataagatccatcatcttggtcatttggaaatatatcaaaactctgtggccttctgatttcaactttaccaacaattcatccaattttcttaatttcgctgattcggtaatgaacctatccatagatggcattgatatgttggatgaaaaatttttatttagtggttcagggaatagtcctgtctttggaaaatcttcaacaggtattccctttttaacgtgcatgttatattgcgttattgctggaatatcggataatgcctgacttatcaacgggtcaaacagttcattatttatgctattggtaacatgactagaaccaagaacttcaatggtgaccggaggagctgaaacattgggatgataaccacgttgtatacagttcagatactcacgttcataggcatgtttttcaacgttcaataatgaagccattacgccctcggaaggtgcatttctagtaacctcgagtagctcttgagtaatggttttaaaacttaaactgtcagtattttttggaccatttgtacgttctattactcgcttgagtaagggtgtagtagaaactctaaaaaattcattcaacgagggttcacctgttaatttagataaaaataagcacagttcataattagttgatgggttgaaaatattaaatttcacgttcttcagtttattggctatgtccacgtcattgttgtaattcggtaaaatcaaatcttcataaatcaaccttggtaggctatattttattggattccttgaagagtaaatcaaatcagtgaatttcccattggaaatattattactgctcatgctagagagattcatattactgttgctaattacgctgctgttgttattagcaacagatgcagttaacatcgaggtagttttaccaaaagtagtgaaggaaaatggagaatctacatctgccctttcaaaaagatccgggtggttacaaactttcctgaattgcatgactgcgttaatcaagttctgatcagaaccagaatttgaagcagaattggaagtagaatcattcgtagcggcattctcaatggcatcatagttagtagagatttgagatttcaaaacctgatataatttagcctgcctttgagttaaatcacataagacatcaatttcaatcttgtcgcccaattctgattggacgttctttttgacacgccttaacatgaacggtttcaaaatcatatgcaaacgacgtaattgctgttggtttaatttggtattagcttctgcatgagattcaatatccttagagaaccattcattaaattcatcgtgagaatcaaaaagagaaggcatgataaaatgtaaaagtgcccatagttcctgcatactgttttggataggagtacccgttaatagtaatctattacgacaatgaaaactcaacaggttcttccatctagatgactgtgaagatttgatagcttgggcctcatccagtatcatatattgccatttcattttctgcaaatagttagcatcagtgacaaccatttgataggatgtaaccatgacatggaatggcgcattcttattatacctcagatttttcctgtcccaaaatttcctaagaactttacggtcattggcattaccccagtatggcagaattttaaattgaggcaaaaatttggatatttcattgacccagttatgcagagtagaagcgggtgtgaccaccaaaaagggcccccaaatattatggttctcggctagatgagccaaaacggaaatagattgcacagttttacctaaccccatttcatctgctaagataccattgataccctggtcgtaaaggttagctagccaattcaaacccttgagctgatattctttcaaagtacatgccaaaatctttggttgctcgatggttatttcacctaaagaggttgggttttggaagttcaactcatcttcctcctcttcttcctcatgcgcattggcatgatcatcaaattgtttcgctttcgctcttgtttctgccagtgcattggaagcattttcagcagctcttagtctcaattgttcgtcattttcgttatcaaagtcaatggcgtgaaagtcatttttatttggagccaaagctgaaatgtcaatattcttctggctttcagaatcattactggaaacattgttcccttccaattcgttagttttgattttccttccaatgaaatgcgaatacaattctgtctgtgttaacaaaaagttcagctttttagcttgtcttttggattccttctcctcttcttccttctttgcctgttccatagcctccttttctatcttcttctttagatctctttcttcacgctcattcttcttccaaaaattggacatttccctaatacctcttctggccctcgtttggaagtcctttatttgtttgaagttcttggattgccatttcttggcttctctagcacaaagtgaggaagttttcctaaaatttgtagatctgattgattgtatttgctgaaccaatcttgacattttcgtagaatccttacgagccatgtctttccaaatagttgtataggtgttgtcgtaatgcctctggatagcacgggcttccttagcattcattttcatgccgtaagtgggcaacccgtgtctagtgttgaattttctcttattagcatcatcggcaccgttagcagtattattgtttaatttccttctcttgtgggattcagatccatcctcatcattatccaaatcattaccatccaaaccaacgttgttcttcaaggcctcttccctttctctttctctcttcgcatcgttaatcagttttttcaaccttttgacgtggtactgtttcaaagttattttgatgttcaacttggaatcgattggattgtagtcggtgacaatacaattggtgaacctcctcttcttaatcttctgatgcttgtttttgttgcacattttgataagttcacgtacaatcttcggcctatcactgttgatggtaatatttttatttattttcttggacgttattaaagacagcgagttcatagatagtttggtggatgaagaagaagaggaagatctctttctccttttctcgacatcgggattaaagtcctcatcgtcattgtcatcctgttcttcaaaggcggcgaaatcttcttcatcaagatcctcgatttcctcttcctcttcgtcctcctctccattttcttcctcgtcatcattgtcactgtcattgtcattttcattttcgttgtcgttgtcgttgtcgttgttgttttcattgtcgttgtcgttgtcttcgtcttcaccgttattgccatcctcgttttcgtctccattaacagtaacaacagtatcggcatgagtttgatcatcctttatggctttcccaatagcggcagcagcagcagcatccttctttctcgatttttgaataccattcccacgcatgctcttcccattggtatgcctaccagtacttgcctcatcttcttccatgtcttcttcaccatcttcaagctcgtcttcatcatcttcttcatcctcgtcagcgtccttttcattgattatgtccgataaatttgcatttttaaaagattggtattccgcccattctttattgatcatgctcatatcacggtacagttttttaaaatgcaggtcctgagaatcattagtgttatcaaattgccaatccttggattgttgattccattccgatatcaactcgaactcttgtagattgataaatttccagtcctgataaagttgctctatcgaatcccttctcttgatacggttgaactcactgttcagttgagatagatacgcttgtttcttatctagcactctggtgggcgccacatcggcaactctctctctgctattcttcttagcagacttgcctgcggtagtctttgaaaaatcagatatatccttgtcctccttattgagtagaactgccagtgacatgtctataaatgctcttctatatgtcttaagccttgctttgctaatatggacaggatcggtagttactcttctcttgttacttttcttttgcctcttcctcttgttcttctcactccactttttttgttttacccgtgaacacgtacactatacgctcccacccaaatgccactcacttaaattccaattcgattcgattccgagttcgtcgttgtctttgtctccttttcctttcctttttttcccacgacttcgtgcagttgcatttgcctctcccactctgtcttttttttttcccatttagcttcttctttggcgtccagcaagaaactacgttgggcacgtctaaggggccaagctcttgcaaccgtaacttatacttacatctacatacacatacatcatatatcgtaaatttacaacagaacatagcttatccaagacatgaagaagacgccggctgtgacgctggcgcgcgatccaaaaagaagtgtctttgatgactatacagaccattcagcttcagaacagacgtaactcagcatcattctcttgcgttcttttaccatttctcttgcccttttgtcgtatttttctcttctatagtatgagtacttcctgtttttcaccttccacgtggatattttcacgtttgcgcgctgcgtctttctttttcttttctggtgactaatcggtggtccatcgctggccaatgaagcatataactgatgtttaacatttaaatcttggtttagacggcatcatctaagcgttattctcatcgtatagtatcgaaaaaagaaaatagtatcatagcacagaggcatgtcaacgtttgggaaactgttccgcgtcaccacatatggtgaatcgcattgtaagtctgtcggttgcattgtcgacggtgttcctccaggaatgtcattaaccgaagctgacattcagccacaattgaccagaagaagaccgggtcaatctaagctatcgacccctagagacgaaaaggatagagtggaaatccagtccggtaccgagttcggcaagactctaggtacacccatcgccatgatgatcaaaaacgaggaccaaagacctcacgactactccgacatggacaagttccctagaccttcccatgcggacttcacgtactcggaaaagtacggtatcaaggcctcctctggtggtggcagagcttctgctagagaaacgattggccgtgtcgcttcaggtgccattgctgagaagttcttagctcagaactctaatgtcgagatcgtagcctttgtgacacaaatcggggaaatcaagatgaacagagactctttcgatcctgaatttcagcatctgttgaacaccatcaccagggaaaaagtggactcaatgggtcctatcagatgtccagacgcctccgttgctggtttgatggtcaaggaaatcgaaaagtacagaggcaacaaggactctatcggtggtgtcgtcacttgtgtcgtgagaaacttgcctaccggtctcggtgagccatgctttgacaagttggaagccatgttggctcatgctatgttgtccattccagcatccaagggtttcgaaattggctcaggttttcagggtgtctctgttccagggtccaagcacaatgacccattttactttgaaaaagaaacaaacagattaagaacaaagaccaacaattcaggtggtgtacaaggtggtatctctaatggtgagaacatctatttctctgtcccattcaagtcagtggccactatctctcaagaacaaaaaaccgccacttacgatggtgaagaaggtatcttagccgctaagggtagacatgaccctgctgtcactccaagagctattcctattgtggaagccatgaccgctctggtgttggctgacgcgcttttgatccaaaaggcaagagatttctccagatccgtggttcattaaagatagaaacaaaacccctcaagagttatgtatatttatatacgcatgtatatgtattagtgcacgtaataaaacggcaacaaaaaacaaaaagttgacatattatcggtacttttattttcgtatcggttcaattatattatatgttagatatacaaagttttttatatgtaattattttttctgctactttaaagaaaatgtcacaaaatcaaataaaaagcttataaatcttcagtaataaaacccttgtgagaaacgtagataccgtccaaaaatttacggatatccttgtttctgacacgacagatttgttgcaagtcagcagcgttttgggaaacgtcttcgacagagttacctgacaagacaatttcgtccttaacgttggtggaaaattcgatagtaacaccatctctaactggaacgtttctgatcttcttgtcacccaaaaagtttctgacttcaatgaatttggcaccatccttttcaacaatgttgacgttgattgggaaatgcgcgtagacgtatctcatcttgtacttgtaacccttggtgacaccagtgatcatgttgtcaaccaaagacttgacggttctcaaagcagcaacgtgctttctgccaccgttgtgaacagcaaccttgatcaattggttgttgaccttggtgaaggtaacatcaatgtgcttcaagttcttggtcaaagtacctcttggaccaacaaccttgacgattctggacttgatgctgacagtgacaccttctgggacttcgatttgttgttcagtttggatgtatttcatgattgaacttctggtacgggcttcttgatttcagaagctttttacacactaatttaatatcaaaaaattgaattgagtgtaaaatatactattatacaatacaggcgcgccagcgtctctgccacattgcctctgacctccgcagttccgctgtgctgcatgtgtgtgtatgccaatattgggatgatgggaggatgttggaaatttcatcgcttcttcgcgtcagtgaaattttccacagaaaaatgaaatgacaaaatgagaaaggatgaaaaaaatgtttcaaaaaattaaaaaataaacccaaacatttctggaaaacagtcttacaaaataaaaaagaagaacgacaccaaaattagcatcagtacaattttttctcctctatacgcaggacaaatactctctgcccaatgctcttttacaaacctttctttttgatatgagatgaaggattacttttgatcttaataatcaaataggtagtaactataatattggatatcagctgtgctaccataagcgacacaaaccccacaatcagataactatacgtcgcctcatttatatctcgcctatcactttccatttgaagaagtgtggtatcgctcactatctggaaaaggccgtcagagacggtattcaatgctttcaccacctgcggtgtcatttgattgaccaaatgcaacaacatgtcaggatcgagcttatcattgtaggtcatctttatcgttacagatttttcagtatcaatcgagctccacgatccgtcatagactaaatttatgaaacatatcaagaactcattacagttcccaggattaacttcgatgaccgacgtcccgctcgctagatttttcttgcttcttaacaaatcaccattcttgttattaaaaacactgaagcccagtgattgcctcccacgctcgtgactggttcctccgaacctgctggagtctgtttcttcttgcaacacgtccattacatggatttcaaaaacaacctccctagacgcgtcattcatgcctgcattaaacacggtacagaacgctccgtcagaagcactgttgttagagctatattcgaaatcttcgtacagggctgctcctagcagcaacgagcgtttaataggcggcactttgaacgacagcttattattgaatatcggcatatatacttctctggagcttacgtcgctacttaattccgcacttgtaataaatagtatgctcatgaaaagcaatattcgacctagtaaatgcggcctactgcacgccttccatcctcggagccccattcgcctatctgtcagtggtatttcctttgtctgagcaatgttcaaggaagctttttccatgttttcacaatgacacagagaaactaggccttaaagacggtagaatctgtaaggagaggcaaaaaccagaaacttttcataagattcagtaaagtctttttactactagagtgtacggcttttattttattttgaacacaactacagcctcaccacggtatttttttttcctttgaagaagtatcaacgacttagggtgcaatagcattacccatccccacattatgatgcattgttaaacttaactttactggcattggctaccgtcgccgggccgagggtacaaaatcgagaagtcataaaatcagggttatatgtaaaatacagtagggcatagcattatataacggggttcttaaatagggctgaaagaagaatattaggtaaaaattctacatttctacgagccctgttttattgatatttcaatataaatacaatagtataacaatagtgtaataatagtagatgaatcctaaaaattgtaggcagaagtagataagaaattgtatattaagttattgtttataagcatagtcacaagtgcataaaaactatgaacggtattgatgatctcctaaatattaacgacagaattaagcaagtgcaaaatgagagaaacgaactggcatcaaaactgcaaaatctaaagcaatcattggccagcaatgacacagaagtagcattatcagaggtgatagcacaagatattattgaagtaggggctagtgttgaggggcttgaacaattaagggcaaaatatggtgatctgcaaatcttgaataaattggaaaaggtagctgtacaacaaacacaaatgcaagctggcgtagacaaactagatagttttgaacgtcagttagatgagttagctgaacaaccgccggatcaattcactctagatgacgtaaaggcgctacactcaaagttgacgagtgtcttcgctacagttcctcaaatcaataatatagattctcagtatgctgcttataacaaacttaaatcaaaggttaccggcaaatataatgacgttattatacagaggttagctactaactggagtaatacgtttgatcagaaattgttagaagcgcaatgggatacgcaaaaatttgcatccacatcagttggtttggttaaatgtctgagagaaaattccaccaaactttatcaattaagtctgctctacttacctttggaggaggaaacacagaatggagatagcgaacgcccactttcacgctcaaacaataaccaagaacctgtgctatggaattttaaatcactagcaaacaatttcaacgttaggtttacgtaccattttcacgccacatcgtcatcctctaagattgagacgtattttcagtttctaaacgattatctaacggaaaacctatacaagtgcatcaacatttttcatgatgactgtaatgggttgacgaagccagttattcatgaacaatttattaattacgtcttacaacccattagggataaagtaagatccaccctatttcaaaacgatttgaaaactttgatcgtcctaatttcccaaatcctggctacagacaaaaatttattgaattcttttcattaccatgggctaggtttggtgtcgttaatttccgatgaagtatgggagaaatggatcaactatgaagttgaaatggccaataggcaattcatcaatataactaaaaatccggaagatttcccaaaatcttctcagaattttgtcaaattaatcaataaaatttacgattatttggaaccgttctacgatttggattttgatctattagtaagatacaaactaatgacttgttcattaatttttatgaacttgacttcatcctacttggattacattttaactgtcgattcattgaatgaaacaagaactaaagagcaggaattgtatcaaactatggcaaaactgcaacatgtcaactttgtgtacagaaaaatcaaatctttgtcttcaaacttcatttttattcaactgaccgatattgttaacagcacggaatctaaaaaatacaattcactgtttcaaaatgtggagaatgactatgaaaaagctatgagtacggatatgcaaaactccattgtacacaggattcaaaaactgttgaaggaaaccctacgaaattacttcaagatttcaacttggtcaacattagagatgtctgtcgacgaaaatatcgggccgtcgtccgtaccaagcgctgagttggtcaattcaattaatgttttgagaagattgatcaacaaattggattcaatggatatcccactagctatttcattaaaggttaagaacgaattgttaaatgttattgttaactattttacggagtcaattctaaagttgaacaaatttaatcaaaacggtttaaatcagtttttacatgattttaaatctttaagcagcattttgagcttaccgtcacatgctaccaattataaatgtatgagtttacacgaactagtaaaaatattaaagctaaagtatgatccaaacaatcagcagtttttaaacccagaatacattaaaacaggtaatttcacatcattgaaagaagcttattccattaagtacttgaaggacacgaagattcaagatgcactctataggattatatatggtaacatattatagctcgtaaaaaaaagagaaggaaaaaaatcaacaagacgagtattattccaaatgtaactccagaccattctataaaccgtaaataaatatataaagctctatcattgtaccaaatcactattcatttcttcaaaccgaaggacctcatcattcggatcttccgaggcatttctcctgtcgattacggcgctaaatcctcttttagctaacgcctcgactatttcaccaacagttgatatcattcccgtaggaccttcgtcaaagacaccgtttgtttcaaccttattcaaccatccatattcttgaggaatgttttcagctttcctatactttttctttccttcggttacgctctgaataggttcaacaacttgtgtggaattgatatcgtcattttcatcgttatcgtcatcgtcatcaccattgaagtggacatctatcagatgatcgataacgggccaaccgtatgcgttggcaaactttcttcggactataatgttgttgtgagcgtcaggttttaaagcaacgacaacctttctccatgccattccttcatgccaccttcgagcaatcgtttcttccaaatttcgatacttcgcacgttctttctttcctgcaaaaaaagcctgaaggagtatattctttttatcaaaaaaaccgtcttcgatatcaaattcggattgtggaatgtcatcctcattgtatatcttatcatgaataattacaggatctcttgaatctggatccattatgtacgctctttcaggtaaaggaggaaggagaattgagcttgctgactcgaaaaatgatactttaggaatttcggaaccattctccgtaggaaacttttgtggcgccagtatactcaacattttagtcagaggcgaaatgaaagttttattgaagaaatcttgattcacaggtgttgaagcatcatttattagcggtgattttttgctgttctcctttagtttctgtaattgctccaagatatcattatagtctaggaacaatagcgatgcggtatacaatgggacaattccgtcattaatagcgttcgcatatactgtcctccttttgaacctacgcaaaatctctatcaagggcagaccagatagcaagtagagaagcggtttgcctacttcaacatcattttccaaacccaagtcttgacctgtttttccaataaccccgaatgaaagtagtactttaatataggcgggattatctgtgactatacctaaaagcggtgaagctaaagtaataaaatttattggattcacctttttaaaaaaccaagggtagacttcataaatgtacgctattgcgaaagcctggattaggccacccaatgaatgacctacaaaagaaatcttgcggatggattcatcgtacaaatcctggataatatattcggccaaacgagtacctaaatacttaactcccttctcagtttgacagacatttcccctataacctttcacaacaatttgttcgtggggataattcttttgtgctttgtatatctgttccataatatacactagatcggtcgacacattagaatgtaaaccatgtgtcaaaactacaagatgtttctttttctgtggtgtggtaatctgaacgggaagattccacaaatccaaggtagttaacctgttcactgtaagtttagggctataagaacctagatgagatggcagatcatgcggattttctactgactctttactagttccaatagtgacttcgtaagtgacgttcgtatttgtagtgaacaatatttgactcatcacatcagcaatccatacgtatttctgtcgtatgttatgtactgaaagttcagccacgaaatcttgttgagtttgcacattcggttcaaatttggggtaatcaactgaagcaactattttttgggaatgatgatattgggcagtttttacatcgcaataaagcatgaatggacccattaggtacgcagctctatacgataacggattcatatttctcacctttaaccacaaggaatttaaattcaaatctggtggaatttcctcaccgtcataaagatgataagtaattacatatctctcaagttcaccaaccttcactgaagacttgtaatgaaacaatatttcattagttggtgtcagagacatcttgagcaaaacacggttcgtacttcactctctttgtgtactattcttactgaactgttgaggcggtacaatttatttcacagagttttgcatatttcgggcatctactatgtgcgtcagttcttacgtggcgcagaacaatagaaaagaagatttacagaagtgatagatacgatatgatatttacaagaaacgaaaagttacgttcgtcagttactctccaataattcttttgcccgttcggtgctatcatatttagacattgcctcaataacttcgtccaatcgttctccagataacacacctggcaggtccaacaatgtgaacccgcacctatgatcagtgattctgttctgtggaaaattgtatgttctaattttatcagacctattggtgctagaaacctgactctttcttgcttttctttctttttcctccttttccagcctttccttctctgcaagtctcgctcttaagatcgtaaatgctttagccttattcttgtgttgagatctttcatcttgcatggaaacaacaattccagaggggatatgggttaatctgacagcagagtctgtcgtattcacatgttgaccacctttcccgcttgcacgcatgatgtcaactctgatttcaccaggtttaaatgttctttcataagcgtcaatagatttagcagattcgtcaccaatttgaggtaacacaaccacggcagcagtggatgtgtgcgtccttcctttagtctccgtactaggaattctctgcaccctgtgaacgcctgcttcaaacctcaaacgatcgtaagatccggcttcttcaatgctcagaatggcatcgataatgcctgacccactttcgttttcatttttcgatataattcgatacttccattttctatagttggcatagccaatatacatatccaatagattctgggtaaaaatcatggcttcaatgccacctacacccggtcgaagctctagtaagctaggtttatctgcgaacggatgcggtggaagaagtttatttaccaatcttgaggaggtcgtttcatattgggggaccagttctgcatattcttgttcagcctccgcccttaatgatggatcagatacaatcatttcttgtaaacttttcaattcatttagtttttccttatactcaataaatgtatcagtgagcgctgataatttagcataatgtttctgcttattcacgtcaaaatgaatgccgcaagaaaggtctttgtcaagatcttttagttcagcttcatacttttccgcttgcttaacaagtaacggagagagttctgtgtattgtgttgggatgctgccgttgctcttagagttagtcgttgttgatgtcagtcgcactagtaacggcaacttgtgacccaaaaaaacacccttaaagatggacctcgaggggaactggaactttgaaagccacatgcttgcaccaatgaaatatattgttctgctctacgaacttttcattcctgagatattataaaacatatgatacgcactattaacgctctgtatttatcctccgagcgagcaaatcctcctaacaagtatatgaaatacacaattactcagcctagtacagatggcacaacgagaagtaacacatatattttctgagaggccttattgcataattatacacatatattaatatcatgtagtaaataaatcactaataattaaaggctttttcgcgaaatgaagtaaactgataagtgaagaatacacaaatttaaatatctgccgctggaatatcgctataatcgaatggtaatttataataaattattatgtctcctgatcttcttgaatcccagtgcgcaagagagttgaagaatctattgtattcaatgtatgatgaatctttcaggaaatcctttagaaatgcgttttccatgtgctcgaaaacaaccaaatatgttggccattcgtggctgtatgttttacctggactccttagatccttacgaaaaggcggtgggaaatttttgtaaatgaatgccgatatatcgtcatacaaatggtcactttcatccatgtaggtctctagtttggagtaagcctctgggtctccaagtaaatgcaatggagggttacaagtaatcgaccacagatcttgaatgtcactgcggtgtaaatagctttgaccaggtgtcgaatgacagggcattatgaatcccaaactatctatttctggctcttcatgtaaaaatttcataacttcgatagatccagattcgtggaatgtgtccaaaagtaatgcgatgaacaccgacacgaatggaacaagccagagtaaagattttaggccagatagtcttttccaataatctctatcaagtctcaaaaggccaaatgatgatattaatatgaaaagtggctgtaatgggaagatgaacctaaattccttatgaggtaacgtagagtacaccaacagattcaacaagatagtgagtttcacttggaaaaacgggtttaaatacttctttgggaaactccttttgcttagtggaaagaataatccaaatgcaaaagcgggaatacttgcacctaatacgataggtaagctttgaaagagatgaaaatgccaaggagccaccccataaaactttgataatggtgttgtgaaattgaattttagaaatcggaaaaagggaaacgttacttttttataaaaatacgtgtcgataattgcatttgcagtaaataccagaaaaaaagaccgtaaaactttggaaaatgtgatgaaaagtaaatgatactgctttttgcctaccaagtttaatattagggaaatgctgggaattacccaaataagtccactgctgggtctttgcaaacatgccagaaatgcaaaaataagcgacttagtaaaagatgactcttttatcatttgtccgcctgtccagtcccagtagtagagggcaatagaagttaaaatcatttcaaaagagttgatgaacgttcttgtaataaaaaagcaattgaaaaaattagttaaacttaaaagcagtgcaaacttcgtaatctcggataaaccgctgcgtctctcctcttcctccttctcgtttctcttatcaagtgtaagtaaatagagcttttgaacaaatcttacgatataatattcccctgtggaagctagtactgccataactattttcggcgcatatatcacaccataatattcgaacgaccgtgtgacgtcaaaaggaagcctcttcaagtcttcagcgacttgccaacttaactcatatttcggcagtagtaaaattaataaatcagaccctatcgttgagagaagaagaagtgcatagtgaagaaggattgacgatagagaaaccaatctataagtcagctcaaaaatcatcggaaataaatagctacgaactccgaatttccattcccaagtcagttcaccatacttgaaagccttccaatgtgccggctccaatgcttgccaaaactcatcagcctgaaagaaggttctcgtcagaactgcattcagtactctaaaggctagaaaaacccaaaatatttgggtccgtcctagtttaggttttattctatgaacctcgtgagccattgaaagttagatattatgttggattacacaatcctacactatcttaatgccttttatctttttccgttcctcatggtgtgaatggcttgaatttcttttaccttaaaagttcgccttttccgcactataacgatctcacttaaacttttaaggatgactcgcctataacttcattcgagtggcaaagcgttataatttatctcaagcagcatttcaaaggattctgacttaaaatgttaaacttcaccggtcaaacaaggagaagaaatgtcaatttagggaataggactcgaaattcaaagaaggatttactggaaaaggccaaaagggaacgtgaaaggagagcacaagataagctcaaagaagacgccagtaaaaccattcaaaaaagcatcagaagacatttttcaaatgtgagactcttcaaaaacacatttactagttcgcaacttgttcatatgataccagcttacgggggcaaattaatctattacatttctcaatatgatctgcagcaactgctaaaattatctcataattttttgagttcttatcctaattctttaggcaacagacagctattgagcttgttgaagctatatcaagatgatgcactggtggctgaaactctaagcgatcttaacatggactgccctacagttgacgaatttttagatagtctatccgtttatctctgtcgggcttcctccttgagttattcctcagcttctaagctagctgatgtcatagaagcatgggaagtaatgcatagcagtgcctccattagtattttttcgatatcgataggatcttacgaaaaacggccatttgcactacagttttattgcatacttgccgaaagaaaccttttgccccaacttatcaacacaaatccgatattatgggataacatggcaaagacatattcacactgtagtaaaggtggccaaaaaaatatcgccaagctactcataccaaacttcaacaatcatattgctccatcagtcttgcgtagtgataacgactatgtcttgaaattttatgaaaaggcatttatagacgaagttattgctactactgcaaattacgtttctgatgaagatcacgtgaagaatttgatgtgctacattgcaagctctcccaatcaaagctgtaagaattctgtccttattaccttactgtctaacaaagacttcgtgagaaggctctcatgggaattctttcacactaaattcaacgccagcaagactgaggctcaccccctgttttcagttttggcacagcttatcgacatgcaccttttaatatcgacagatcgggagttattagactacaactctgtgatacctatcgaagaactaaagaaatttacatccacgttaaaagattttactttccgacaatattgggaactacctaaaagtgaaaggaaccctatgttaaaggaagcagtaccacttttgagcaaagtctacgaaagggactcaagattgcactttctatccacggagaataatccaacctattgggaaaactctgaaaagcaatttttaaatttgagattttacgaagaattacaggagtacgaagatctgtatagagaacacttagaagaggaaagtgatgaggatatggaaaaggaaatagatcttgataaagaaaggcctcctttgaagtctttattattgaacaaaatgaaaaagagattaaagtcatcattacgtttccgaaagttggaaatacttttggaattaccattttttattccttttgaagaaagggtggacttattttatatgttcatcgcactggacaagaagcgattatctttagatgacgatcacaacttgatcaatatgtttaccccctgggcctccaccggtatgaggaagcaatccgctatcatctctagggataatgtcttagaagatgctttcaacgcatttaactctataggagaaaggttcaaagcttcattagatgttacttttattaatgaatttggtgaagaagctggtattgatgggggcggcattaccaaggaatttttaactactgtgtctgatgaaggatttaaagatccaaagcacgagttatttcggacgaatgatcgctacgaattatatccttctgttgtttatgacgctacgaaacttaagtatatatggtttctgggaaaggttgtaggcaaatgtctatatgagcatgttttgatagatgtatcttttgctgatttctttttgaaaaaattattgaattactcgaacgggtttttatcttctttttctgatctgggaagctatgattcggtgttgtataataatttgatcaaattattgaacatgaccactgacgagatcaagtctttagatttaacctttgaaatagatgagcctgaaagttccgcaaaagttgttgacttaattccgaatggttcaaaaacgtacgtgacgaaggataatgtgttgctctacgttactaaagtaacggattacaaattaaacaaaagatgcttcaaaccagtttcggcataccatggagggctcagtgttatcattgccccacattggatggagatgtttaactctatagaactacaaatgttaatatcaggtgagagagataatatcgatttagacgatctgaaatctaacacagaatacgggggttataaagaagaagatcagacaattgttgatttttgggaggttttgaatgagtttaagtttgaagagaaattgaattttttgaaatttgtcacgtccgttccgcaagctcctctgcaaggcttcaaggcattagatccaaaatttggtatcagaaatgcagggacagagaaatacaggctgcctacggcatctacctgtgttaatttattaaaattgccagattatagaaacaaaacaattttgagagagaaattattatatgcaataaactcaggcgccaggtttgacttatcataattcccagaagattagggaggtaattaattaataggcagatttctagttcttatatattactatagataaggaaattatacgcttgtatgcagagataatttaagttttgctttgttcgccaccattctagttatgacctttatctatcattctattttttattggaaaggctttacaaaaaacaaacagtaaaaattctttaagcgaagtgaaatcgacaatgaatatgaaattggtaattatcttacattaggacttttcaatatcttagtccttcttttctttcatgtgacttagcaccattttcaaagctaatggcaaatcatcatcagagctttcatcatcatcgttcagataattaggatccgcattaccaagggtgctgtgtctgcttaagcttgaaagttggccggaggtagaagcaatggaaaatgctctatttctaaatgtctttggtaagccatccgcgttttggcctgctttatgagaagcaatccgtaataaattcaacgctgccggattatcatttttttcgtatgccactggacattccggctcataacttcttgtggaatcaggagaaatttgagattcattagaatttgtactttgtaaactttcaattccttcggaaatgatggaagtaccatcaaatggggtccgattgcgccgtgtattcataggattgcttttcccgttaatgaaattatcaaatcctgttactgcctctgcagcccagtcctcgtaaagtggacgcgataaaaacccgtatttaaactcatttacaccgaccagaattttagttaaattcaacagctcttcaatatactcaattatttcttccgatgcagcactagatgcgttccaacttaaaaatttttcttttaaaacatattcatgaggattagctgttgtgttggcctgtccccttctattcattttcattaccaaaccttcgttatcatcgtcatcttcatccttgccgtcagcgtaatctccttcatttggctttcttgctttatcacttaaatttgaaatctgcccaggatatcttattcgcagagtttggcgcactttattaatcagccttctatgtgcaattcttgcgctgggcaaaaattgcggtaacggggtcttatttataaatgcctcttgaagtgctctcattaggcaagaaatacttccaaccatttggcgtcgatatggatatacaacactgttaaattcttcaataaccgcacttccattttgctttctcagcaaggaaattgtatctatcctctctattatttgcttctgaataaatataacttgagtgaaaacattttccaactcggtatattcaccctttaatctcggctcttgtctggttagtcctttataggccgtagcacgggctaacgcctctttagcactttttgatatcttttcgatttttttgtatttctcttcactcatactacttgcgacttgctctccttccagtccggtggcgtagagaagttccatttccgatatacagccacagacaaaagaaatctcttcatttaattgttcccgtgccttcaatggaatgaaaaagacttgaactattaatgctacccctccaccatagccgacagctaaacatctcttggcgaaactagtcaatatatcatcttgggagggaagtattgctgcaagcataacaatataaatactaataatttcaataattgcagccttcacatagggtgtgcctaataaatagtaaaacccaggaatggctccaaaaactgtgatgactgtctccaaatatggattggtttggttgacagcagcaacataggaaagataaccccaggctgctccaaaaataacccccacagcacgcaaaaagaagacccagaacgtacctcctacggaaggttccaaacaaagtatgcacacgaaaccaatccaggtaccacgatagtctatgtaccactgccttgtctttggaataaacatcggaaatgaagccagcattaatgcaatggctacctgaaatccaaatctaaagtgaggatgtgacacttcacaaaacttatcaattgaaataagcatggacataaaagaaaacctgccttgcctcctggaagttctattagttccgaacgtagttgttttcgttaacgttaatggcgacgaagaagtgtcagaggtagaagatgaatttcctttgggttcacttgtcattggcagatctagcgatgcatcatcttttacaatgttcttattcgatgaaactttttgagataaaagttcattctcttcataatcaggccttctaataactgtgtcatgagcaaaaccattagtattaccattgaacgtaccctttaatgtatcattttcagtcactgagttcctatcgccttttaaccagatagaaaatgtctcgtagttggtcaacactaaaaaccaaagtcttttgcctctcagccagcccttcttctcttgtatttgacgtttgactaaaatgtccttgacggactccataattaccaaagttgaatctgcagtttgcctaaaatttagtagaaagctagacaacaaaaacatttcatcactaggactcataatatcaatatcaaaacttaacatttctgacttgaattttgctttacattcttctaacgcctgcttcaggtcattgatcttgttctggatgtcaacatcattgggcagattattggcgttattactgaatgttgggaagttaccatctttgaacattgagcaggaatgaacccttgaaactttcacatcaaatgcatgagcaagtaccaactttgctatgtacatgcattcactcattgtccggtgtagactataaatcactggatgcaacttgtcaataactttcaacaacttctcagcatttgcaaagctgatttctttgttctttggcagtgtcaaagctgcgacatcatcaggcctgagcttgttatcatgtcttgccaataaaataaattctaattggcatgtattaactaatccattaatgaagactgtcaaattttccaaagtagatatgattggctttagtttagttggcgaaacataagcgtaagtaaactcataaatgcactcgtgaagtactactcgacagttgttaactttagaagaaatcagtgacttcatcttcaatagcttgcctaacgaaacaggatctctactgtacaactggctactattgtgcgggtcaactgcaatgaagaaatttatcgaatagtcaatggacttatggagctcattcatagcatcaatagtcgtattacccaaatatgtggtaccccactcaggaaacaacacaagattccagaaaatcgacattgcaatacccaggtagaaaggcgtactataagctttagcaatagtgcctgctgtttcattcaaaggatccataaatgcgaaatgaaccacgacaaaaagtgggaaaacaataccaaagtaatagtgtgatacagatctcatccaaccatgaaaaaaaagcataattacttcgaaaacagccaaaattgctaatcccgcttcatatcttttatagtgcaatacgtgctgctgtgcctctgttagctcatgccaagaactccctaaacatcgctgcgcaaggaaccggccgaagattgcgtaagctaggccaaatatcaatccagttatgcaatagatagcaccatggatagtacccccaacccttcttccagggtgaacaataacagaaatcattggcagcatcgcaggagctgctcccaaatgcgcagttatcttaggtatcaagcaaaatatgaaagctaccgtagtattaacggtcgatttacatattctcttcgcgaggattctgtcacaggggaaataatacagccataacttctgaatcttagtcaactttgatttaagcgacatggacaaataatgaagtcaagcaattgatgcaaaggataaggaagattttctcgcttgaaaatatgttctcttcgaactccaggataggataggaataaagtaaaaatagtgtatgatacgtagttaggccacaaccacaattataacctctcgatagcaggtgttaatagagatgaaggtagatcctggatttctcttttctttctttagacatcaaactggtagttcttatcagtctcagccttttgaagacctatcaattttatgaggagggtaatggttgcttccttttccctagcagcggcccatcgctttagcttcaaatagttgattcctttaactgttgactatgaaaaggtagtcttcgttgggattggggataaaagaatatctgaatactgttgctgtctgtgccatttactagcttacggacgctatcaaattaactcaaaaacgcttctgttcatccgctttccagaagatcaacgctcaaaagacaacaaaacaattcgaagacgtcattcgttatagagtgccaatcaacattggtgggtactagaaaacttctttgcaaagtatagctaagaaaggtctttttatttacgagcgggccataaataaaaaaatttcaacaacaacaacaacaacaacaacaacaacaacaaatagtagagactagaaaagtatacccctcacaggcatgagatttcttcaggtttataaatcatcggcattaattggactaataatattgctggccagtaaagtaaatcttgcagaggcaaaaaggaagctggtagccacatcattggtcacatgtatggaaaactcgcagctgtcagcaaatagttttgacgttgttttcaatccagacgacaggtcattacattatgatcttgatatgtcaactcaaattgattcatatatttttgctgatattgatgtctacgcatatggtttcaagatcattactaaaaatgtcgatctttgttcaatcaactggaaacagttttgcccggttcacccaggtaatattcagatcgactctattgaatacatctccagtgagtacgtaaatgaaattcctggtattgcataccaagtccccgatatcgacgcatatgccagggtcaagatcaccaacaatgtgagcgagtacctagcatgtatccaaatatacttctcaaacggtaaaacagtttctcagattggtgtaaaatgggcaactgcagtggtagcgggaattggtcttttactatctgccatcttatccacttttgggaactctaccgcagcctcacatatttctgccaacacaatgtcacttttcttatacttccaatctgttgtcgtggttgccatgcaacatgttcatcgagttccgcctattgcagccgcctgggcggaaaacttggtttggtcaatggggttaattagaatctcattcatgcaaaggattttccggtggtatgtgcaatccactggtggtacgcctagcttatatctgacttcaacatctatgtctgttttggctcaaagaagttggcaatatttgatggagctcccattaatcaaaagagctaccaatgttttgtatggtaatgcaaatacattaatttttagaggaatcaaaaggctaggctataaaatgggaatcgaaaatacgtccatcgtttgtaccggttttactttcttcgtcttatgtggatatgtgttggctggatttatcatagtattcaaatgctgtgtggagttagccacccggttaggatggatccaaaaggcaaggttttgggaattcaggaaacaatggagaatgatcttaaaaggtgctcttttaagatatatttacatcggtttcgttcagttaacaattctcagtttttgggaatttactgaaagagattcacctgctgttatcgtcatcgcatgcctttttattcttttgtcatgtgggttaatgctttgggctgcatggaggactgtttttttcgcaagaagatctgttgcattgtacaacaacccagcagccttattgtatggagatgaatatgtcttacacaaatacggatttttctatacaatgttcaatgccaatcattactggtggaacattgttcttttatcctacatttttgtaaaatcattattggttggatttgctcaggcttctggtcaaacacaagttcttttcatgttcatattggatttgttttacttcgttgctattatctactataagccctatctggaccgtccaacaaacataatgaatattttaattgctactgttactgtagttaattcctttctattcatgtttttttcggacttgtttaaccaaagctacaaagtggctgctattatgggatggatatttttcattatgaacgctgcattttcgttcattttactaatgatgatattggcattcgctggtatgatgcttttctcaaagaaccccgatctaagatttaaacctgctaaggacgatagaacttctttccaaaggaacactatgaaaccagaaggtactgttaatagatcagtagcgaacgagttgcttgcgttgggcaatgtggcaaaagaccatgacgacaattcagattacgaatcaaatgatactggtgtgaatgatgagctaaagcaaccacaggatgaaaccactcccacaaccgtaacatcaagtgatgataacaagcctacgttttcagagaaaatattaagtaaattgtctaggcctaagaatgaaaacgcaagcacagatgctctgagagttgaagctccaaaacaacaaacgtttcctcacaacttaacgaatctttcacgagaaaacctatcaacattaggctctaaaccttatccaggacacacaagatcacagtctgatgcgcataatggactgatcaattcctttgaagaggaagatacaagttcaaataccgatccatttcacgactccactgaaggagaccttttagatacctcaagttcggacggaggatttaggtcgcaaaactatgttcgagatgacagcataaatagtttgggaaacaataaacaaccactgaggaaaccccctggattcttcgatgaaggatttatgtgagtctttacgatatacaaaagttctgctcctatcataaaaatttttaattttacaggtttttctcattctccttctaaccttctaaattctgtttttgtcagaagtttcccaagttttctttttcattaataacgttaaaacactttgtaccagtttgcttaatatgaatttttttaaaatagatagcttttgttatctttgtttctatgttgtaatatcccagtttgtcatatttttaatactcctcgtgtaacaacaaattaaaaaaaaataaatacttaaattaatcaagttaaataaactaatcgaatcaaacaaacaatttattataaaattatgttttttcatgaataggaatgtgtaagttgttcagttcttaagaggtatcttattttttaacatctttgagatcttcctcctcaaatatttccttcttgtaatatttccactattagagtttctattatgtgcggctatcgctcttattagtgcatcatgaggcctttctatgttttgcgcaatccgatttattgtacggtctagtttttcatgaaaattcgggacattttcattcccagagctatcatattgctccataggatttatttcgtttatccaagacatttctttgtttttaaactttcttaagtttttatagctcttccaaaactccgaagttaaggatttatattccaattcgtttgatatgttcttatctgaatggatgagcatctcatatttggacataggaatacttaacgtatgtagataaggtaccaccttggtgattcttcctttaattgaccaagatattttgtaatctctaatatcatcagaaataataggcgttaatggaatagtttcaaaattgttctgagtggggggatgcgtctttgaagaattgcaaacaaatacgaatccaacaaatttattaggaaagtaaagggttacattacgctgtgtatatttctgcacccttgcaaacttgaaacatactgagctgttttgggagatagtatcatcctcctgggctggaatgcatagtggttctgcccaatctaaatccttttgaaagggtagaatatgattccaaattggctttcctcctttacaaaaggtcacttgaagaaaattattgatttgcaagggcgctacctggtattcatattgtttttcaattacaaagcctgtgtacaaagtactttgttttttgtattgttcgtactcctgcttcaagttctgtaacttgtcacctttaagaacatttaagaagaactctgtctggaaattttggtcttcgaacttacacacatcatgtccaggaaatgaactttttccttgaacgaaagtgctcttaaataaggtgtacgttataaaaaagaagaaaaattctaaaaagttgtacattcatccgaggagcactttggatattataatctatttttagttttgttgctttgtattgagctgtataaaaatcattagatccacattactaattattgaatatggacaataatatcaaatatattattatcaaattgattattttgtgacgcggcgtcaaattttaatcgcgtctgacgaatgagcgggtaataaactgtctttttttcatgaatgaatcgagctggcattaggaacatgtcgtgtaagatttgggagtaaataacagaaagctgcaataaatggtagcttgtaatggtgaattaagacacccaatcgaaacaattatacggacacgatgaagttggatataaaggtatgttaccagagcgcgttttgccaatgcaattgcgaacaagctccgacaactcctatgattaggaaatgatctcgttcgcgaagaatacaaagcctgcaaaaagcaaacattaagattagttactaacaggaagatttttgaaataaatgcatttgctcttggcatttcctttatttgacactgtacatttatgatagaaaacttttagtaatagatccgatcgagttaaaggtatcgatttccatcctactgagccatgggttttgactaccttgtactctggtcgtgttgagatttggaattacgaaacacaagttgaagttagatccatccaagttacggaaactcctgttagagcaggtaaattcattgcaagaaagaattggataattgttgggagtgatgatttcaggatcagagtcttcaactacaatacaggtgaaaaagttgttgatttcgaagctcatccagactatatccgttccattgctgtacatccaacaaagccttatgttttatccggcagtgatgatttgacagtcaaactatggaattgggaaaataactgggccttagaacaaacttttgaaggccacgaacactttgtcatgtgcgtcgcattcaatccaaaggatcctagtacgtttgcatctgggtgtttggaccgaaccgttaaagtttggtcattgggacaatcgacaccaaatttcacgttaaccacaggacaagaaagaggtgtgaattatgttgattattacccgctacctgacaagccttatatgattactgcatcggacgacttaaccatcaaaatttgggattaccaaacgaagtcatgtgtagccactctagaaggtcacatgtccaatgtttcttttgctgttttccatccaactttacccattataatttctggttccgaagatggcactttaaagatatggaattcttccacttacaaggtagaaaagactttaaacgttggtttagaaagaagttggtgtatcgctacccatccaacaggacgtaaaaactacattgcatccgggtttgataatgggtttaccgtactttccttgggaaatgatgaaccaactttatcacttgaccctgtcggtaagctagtatggtcaggtggcaaaaatgccgcagcttcagacattttcactgccgtcataagaggtaacgaagaagttgaacaagatgaaccattatctttacaaactaaggagctgggttccgttgatgttttccctcaatctttagcccattctccaaatggtaggtttgttacagttgttggggatggtgaatacgttatttatacggcgttggcttggagaaacaaagccttcggtaaatgtcaagactttgtttggggccccgactccaatagttatgctttaattgatgaaactgggcaaattaaatactacaaaaactttaaagaagtcacatcatggtctgtcccaatgcattctgctattgatagattattttcaggtgccttgttgggtgtgaagtctgatggcttcgtctatttcttcgattgggacaacggtacgctagttagaagaattgatgttaatgctaaggatgtcatttggtccgataacggtgagctggtgatgattgtcaacaccaataataatggtgatgaagcaagtggttacacattattattcaacaaggatgcttaccttgaagcagcaaataatggcaatatcgacgattcagaaggtgttgatgaggcttttgacgtattgtatgaactaagtgaatccattacatcaggcaaatgggttggtgatgtctttatctttaccacagcaactaacaggctgaactacttcgtaggtggaaagacttataatttagcccattacacaaaggaaatgtatctattgggctatctagcacgtgataataaagtatatttagctgacagagaggtccatgtttatggttacgaaatatctctagaggtgctggagttccaaacattgactttaagaggggaaattgaagaagccattgaaaatgtactcccaaatgttgagggtaaggactctttaacaaaaattgctagatttctggaaggtcaagagtattatgaagaagcactgaatatttcccctgatcaagatcaaaaatttgagctagccttaaaagtcggccaacttacgcttgctcgcgatttgttgacagatgaaagcgccgaaatgaaatggagagccttgggtgatgcttccttacaaaggttcaattttaaacttgctgttgaagctttcacaaatgcacatgatctagaatctttatttctattgcactcatcttttaataacaaggaggggttggtcactttagctaaagatgctgaaagggccggtaaattcaatttggcttttaatgcatattggatcgctggcgatatacaaggcgctaaagatcttttaatcaagtctcaaaggttttccgaagccgctttccttggatcaacatacggtttaggagatgatgcagtcaacgatattgttacaaaatggaaggaaaatttgatactcaacggtaagaatactgtatcagaaagagtttgtggggccgaaggtttaccaggctcttcgagttcaggagatgcccaaccactcattgacttagattccactccagccccagaacaagctgacgaaaacaaagaagctgaagttgaggacagcgagtttaaagaatccaactcagaggcagttgaagccgaaaaaaaagaagaggaagctccccagcaacaacaatcagaacaacagccggagcaaggagaggcagtgccggagcctatggaagaagagagttaaccacctcatagaaagacaaataaagaactaatcaacgaatgagaaaacatctttaatggatggtatacatatatatatacagatgtacactttttatttttattgcgataggtgtgaaaatgaacgtgacttgaaactttgcgcgcaaacaaatcatattatgaattactaaacacgtccagtttatctacatttcttttcttctttaatccgatataataggtctcctttgattcgtctctagaagcgtcaggcttgaacttatgaacgttagtgaaaactgcctgcattctttttttaaataggttttcttcttcgccggtgtatagtttacaaacaaacgaacctaatggccgtaataaatctatagccgtaactaaggctgcgtcacataaatcaatagattggtaatggtctcttatactgacaccagatgtattagccatcctaaaataagcttgattagtaatgttgttccaaaaaccggttgtttggggccagggttcatacatatcacttataatcacatcaactgggaatttttctcgttctattagggtactattcgtattcggagtttcataaatgtcatcagaggtgaaaatttcacggtacaattcagtatctttcacatgggttagctcctcctcgagcatgttctggaaatagccatggtccttatgcaaatcatcgtgtctgttcaattggaaatgcttagaaaaaaagagccgtataagatcatgagttcttttggccaatatattagcttgaatagagttcacaccatgcggaggttcacaagggagaatgtcaacgcccagtatcattgaattaggtgaacttctttgccgtgctacttgggaccaagccccaggggcatacccaagatctagaattctctgatcggtcctgtttttgctaaaaagccgatatttatcatcaatctgcataagcttgaatgcggctctagacctcagattttggaccttggcctcttttgtgtagggatccttcagttgtctattcagccatctgttttgtgagttagaattataccgtacatgtattcgacctaaagaagacgatattatactcctgatacgattgtacactaaaatcatgctgtaattttcccgtcagtatgtgtagtcattacttcaaacctcggataagcccatcttgatggctacgacttccatctatatcagaggctgacatttttctctcattgacggagacgccctttaaccggacctgatcatttttaaaagaacgccagtaaaagagatcttacaaataccagagaaacggtattgaaccttcttctttgattagaacaaattacttgatcttcttttttaaaaaagaactgaaaaatcaaaaacgatacatgaagatggtatgtaagttagctaaataacttgcttaatttcaagaaaggggactgtaaaaaattcagtttactctaccattatctccattaacatatcaacttttagatcgcaatgaagaagactgcgttcataaaccttacctcataaggccaaacagctatcagcttttggcaaaagttgaatacggacatttttgaacccatacatctttcaatatgcacgggtgcaacctcaaatatttaaagtttttttttcctgaaacttttttttcgcacacaataatgccatagacatcttttggcctcagattggaaagtccgaggaagaaagacgcaatcaatgggaagagtgttgtatttggattaagatatgtaagtacatcttcgcagcacttcttgagcattacgttatttggtaacctcttgaagtttcaggaaagactccatagaactagtcgcaagcctcacggaccaccaaatactttggaagactaattacatatcataaaatgtctaagatcacctcttctcaagtcagagaacacgtcaaggaattgttgaagtattccaacgaaaccaagaagagaaacttcttggaaaccgtcgaactacaagtcggtttgaagaactatgaccctcaaagagacaagcgtttctctggttctttgaagttgccaaactgtccaagaccaaacatgtccatctgtatcttcggtgatgctttcgatgttgacagagctaagtcttgcggtgttgacgctatgtccgtcgatgacttgaagaagttgaacaagaacaagaagttaatcaagaagttgtctaagaagtacaacgctttcattgcttccgaagttttgatcaagcaagttccaagactattgggtcctcaattgtccaaggctggtaagttcccaaccccagtttctcacaacgatgacttgtacggtaaggtcactgatgtcagatctaccatcaagttccaattgaagaaggtcttgtgtttggctgttgccgttggtaacgttgaaatggaagaagacgttttggttaaccaaatcttgatgtctgttaacttctttgtttctttgttgaagaagaactggcaaaatgttggttccttggttgttaagtcctccatgggtccagctttcagattgtactaatcacttccgagcgattaatacatatctccatctttttaaataccttttttaatacgtatgactctaagtagtaaaagtattatgcatagttttagccagatatttttgggcccggaatatatcttttcgggaagctcggagtatattgcaccgatccgattcttactccatatcatgccatttttctttcctttctcagcgatgttttgtaggaaatcacttagaacttgccttactttaaaagcatgttgagtgaatttcacagatcgatatgctttggtgttcaatcagttcaaccatacctgctattatataatcttcgactcgcataatataggtattccatgcgcaaatagattacttgcaaaatggacatgactaaaaaccacaccactgacacagaggagtttgatgatggtgatatacgtccagtcagtttgggaattgtggacgattataacgcttcgttcgaattacctttgaaaccaaagtttttacagagtgagaatttctcagatttaacaagtgaatgggaccagtctagatcaaatacgcctggtcttgcagaaggcaagactgagaaagcacagccatgcggtacaacagatagttcaaaaaatagaatacatgtagagcaactgttggaatccgctaatgaaatgaataattatttggcgcagaatatagagaacataaacaattttcaggtggggctattgaatggagggaaaggattatatagttccatgggtgatgattcgagcgcgtgtattaatggcactaattttagctcaacgtccaattttgaactaagtgatgatgagctagaggataccacgggttgcacaagttctatttttgataaagatcttttccatcaacaaaacgggctaagcatacctcgccgtagatcaccactcttcaaatctccaactgccagtttcgaaattggcgatgctacggatgtggaggagcaagatattgatgactccattttttctgaatgtagcagcattacaagctttgatatgggagggttgcatatcagtctaccacacgatgaagaagaagatcaagaaaaaactaagtccgaaagtgaaaacccgttgctacatggcataccggttgatgtagaagtgccccacatatcggttgatgaagctctggcgaatttcaaggaaaccatagaactgctactaaaacttagtggcaatagaaagtgtaccggtttcaatactagagtggagaaaaaagaatactcgaatttctacatgaaaagtaaacccaccttaccatcagcagattttctcaagagaatccaagacaaatgtgagtaccagccaactgtttaccttgtggcaacatttttaattgacacattgtttttaacaagggatggcaataacattttgcagttgaagttaaacttacaggaaaaggaggtccatcgaatgataatagcagcggttagattgagcacgaaattattggaagatttcgttcactcacatgaatatttcagtaaagtatgcggtatttcgaaacggcttttgactaaattagaagtcagtctattgatctgtgtgtgcaatactaaattaatggtcagtaacaggaaattagccgcctccaaattacttttgaatgaactacggtctttctgtgtatagttgatacaagtattttagataattattttaacgaacgtaacgaatgctttccagtcaatagcggcactggtaatatgatacaaacaatttctcaataaaacaacgacaaactttgtctgtttatatgtccgtgcaatggtggaaacctgtactcgatattggagaaaacttcagagcttcccaacagttatcccggattcttaattgatgctctcgaaacgcacataaaaatgtgatttttttactcgcattaaattactgttgaatctatggttcaaacaaatgtatatttgcctacacatctttctctgtcccttctgtattgtctaaccttaaaatagaaatatttcatggttttatttcttttaaatttattatccatttttaacgtggtgagaaaacccgaaatgaaaaataataaaggaaaattatagaggaaaaaaagtgtagaaatagaaaaaaaataaaaaggataataccgatcagaaaaatcctctttcttgctcttcttcttttctttgtatttctcctgaaaaaattcagaaaaacatatattgggttaaatacataactatttaaaaggctgtaaacaattcaactgacattagatacatcacactcaattactgttggaaataggcagatatatccagatttttacaattactatagcacttccattgaagatatataaaaaaagaaaataacaataggaggaagtaaagaaagccgttaataaacaatggtgttatataaaaggaaacctatattacttcctgatccaaaacctttaccattggatttgaatgtacaagtatggcatattgaagagactggagaatggttttctagttacgaagaatttttagaaaggtttgatttctacacacgccaccattttacatgcgaaatcactggtacttcttgcctgacttttttccaagctctggatagtgaggagacacaattcaaatacgtcgaagacagattcccattaaagttgagagaaccagttgcaagatttttacattttaacggaataagaaggttagatgcattggtggagaaagtttacgcaagatttaaaaatgactttttcccaggagaagttgtttatctacgtaaacagaaagactcttctaccacaagctctaattcccaacaaagtactcctcaacctgatgatatggtcgaaatcaacagtgttggtaatcctggcttaccgcagtaccaataccaaagacgttatgttatcaaagaaaaggtccaatttaacgcaacgataaatccagagagcagggaaattgtgatgcccgctcatactaaatacatgctgatagaagaagcagcttccagtaataaatccttcattgttgatcaaggacaaatttacagggaccgttccactttcactaagcacttaatcaaatgttttttcaagattactttacagagggcatcttcgaaaatgggtgcaccttggtgtgtcaaaccggaatatttagcgatgtatggtttaacgatggaatggccaaaagatatgttaaaatataaagaagatgaacctgtcgtagcaagacgttccaacagtgccaatgtttcatccccagaaagtgaaaagaataaacgtcaaagtaaatcatcgggtaaaagtaacacctcaaacgatgcttctaacaaaaaagaaaccaagaaaaaaagaaagccaaccgaagtaaatgattctgagaataattcttcggaagaagacaagaagaagggtcaaaatgtcacatcagaaacacattctaaaaaaaggaaaaaggaagccaatgaggaaccgaacacggaaaacgtcgaaagcgttcctacaccagctaatgcggagcctcaggctgtaacaataacgagcataatggatgacctagctttgccatatcaacatccaccgaacatctttccaaacttaacgtattataatgaaaaattagaatgtatttcattaggttctacaaaactttccagaccttttgattcttttggaaagctattacaagcctatcagtttctgaatacgtttggttcgaaaatttgtctctctcattttagccttgaccaattcattacttctttgaaatgtacagacccatatgagttaaagggcgaagttgttttagtgaacataagaacgcaaacgtctaaagaacaagaaattgaaaataacggcctgccgatgaaaaacaaagcagagactactactgaggaagactctgaaaacccaagtgactggcaaagaaattcatttattcgtgatatgataatgaaaagaaattccgacaaggttgagtacaagattgttcacgatgacccagcatccgatgatatacttgataatatcaatcataatgggtctgctcttctcattgaagtttttactgcgctcttacgtttgttcatcaacgaagaaggcgattggagttgcatcgtcgttgaaaactggataatagacgacaagggagtccttatggagagaaaagatgaaagaggggagggggaggcgaagcaaaaacgaaatgctcacggatactttttacaagataaggaaaagatcgacaacctaaaggacacattaaaggaaaacgcaacagaagttcaaaaagaatcagacgctaaaaacgaaacaaattcagaatctgattctaaatctgattctgacagtgaagaacgagatcctaaattagaaaagtgtttgaactaccgcaatgttaactggatagaacgcttgacgaaaaggcaatttaataacagttactggctaataattttactgggagtcttagaagattgtagacatcttcccatgtatacagagtttattgattctttcatagaaaagatcatacccaaagatatatcagctactcaattgcccaaacagctttggagaaatttctgtcgaaagctgtcgttcagtgacaaagtcaatgcgctgtggatacttgtagatctcgtatcgcatttttctccagatatcaaagctgctgtagatgattccatggaactatgtggtcaaattcgtagcgaaagattcaaagttgcgagagagttgaaaacggaggcagccgtcttaagtaatcttcaaggcgacctgcaggcaattcaagagaagttaaataaaacagatgaaaacacaccatcagccgatggtgccgataaaaaagatgattccgaatcaaatagtgaaccaattgatcttattatcattgagaaaaagcaaaagttaattgaagagcaggataaaaaggtacaagctttacaatcagataaaaatttcctcgataattgtctatttgaaaacgatctacaaagattaaagccgttgggattggatcgatacgggaacaggtatttttggctggatcacaatggtgttccatttcctcaatatcctgctggtatgaatgagacgccgaaaagtaacaatagtttgagttatcactccggtcgtttattaattcagggacctaaagcatcatcggcgaaattctttttgaacgtcagtgatgagcaattgagcaattggcaaaaaatcagaaattccgaaggaatatccgaggcaactagggaagtatttggtatctccaaaactagttccggatcttataattacgtagaaaatggaatagaggtcgaactattggacagtaatgatcgcgtaaacccacttatagagctgacacctattcaaaagaaaattatggatgaaacaccttcaaggttgctactatcaccagatcaatggtattgcattgacaagttagaggacttgtcaagaataatggactggttagataattggggtcgcaaagagcatgatctcttgaggcaaatcagacccataatggaacgaattaaaagttcccttagcttgcgcgaccatgcgctgtcactgacagcattcaccaaaaatgaagaaaagttgctaaaggagttagaaaataatgaatttaccgaaaacgaattgaacgttgatagtatggatgttgatgataaaaatagcggtgttaaaagtgaggttgatgtacaggttgatgccgaagagaagagagaagctgtgatagacgaaaagttggaggtgattgcagacgaactcatgaagctagatgatagctcgaaaacacgcaatgttcttaatagaatacaagaattagaagatcagagagatgaactcttggaacagaaaaaatccataataaattcgcagaggccaggcgcgaggattttagcccgttcagaaaggaaaagaaccaaaatctcccgtggtaataaggtgaataagcagattgaaatattgactgacttagtcaattatagacattttaaagctatggaagatgtgatagcttggaaaaacgttttagcaaattcgatatggggttcctcacttcgcaaaaatgcatctggtaataaaaggagtggtgtcattgaaacagtagacgataaattaaaagatatagtgggccaaacctcaagaacagtaacacctgccccaaattaatatataaaaaacttcctttgtaactgatggtaaattgtagtattcataaataggataagattattcattgtaagcataatggaaaaaaataacacaacaaagccgcgcaagattggaccatactttctatctaaggtaactatcacttactggcttgatggatgcgtatttttgtcggtaccagcttctgaaatatcgatatcaaacatagctggctcaattccttccatcaattgctgggtaatttcgactggtaaaccgttatcgttagagatattagcagatgcgctatcaaaatcgagttcttgggcacctgatctcaaattgcaagaatggcaaataatatcttcataccagtataaacttttgtttgtaccacaatgtgggcaagtcctttcgaaaggaagtacgtaaattttgggtttaatagcagagtcgtgtgagtttcctggcatttcgccgtgtcgcagtctaagctgttcaaaatatctcaactccacaagactatggtcagattcgcacttataatatctgcagtattgttctatgtatgacagagtatgttgaggcttgtacgataatggataaagttcgtttccttctaagctgatatcgtgtctatcgcatattagtataggtctcaaagtgtatgtatcgttaagcttgacatcctttatgcacggtagagtggtgtctacagacatatttttcttttcaaacataagcttaaaattggagctgttctgtgcacatgtaatatgatacctatattggcatttgttacacttcactaacccacctccatttatcctgcacacaccacatgtaaatctactatgtttaataagcacagcagtggtattaagggcaggttgcattgattgtccgtttccatatttgatatcttcattgaaaagtgagcaaaccaaatgcacccatgtccctaagctcgtgcatttcaatgcgtctggacatattttaaatgattggctcctatatctatcatagtcatagtccttcgtaggacacatactacattggtaggtcgttgatattataggattgaggtcatttgaacaagggtcacataaccatttaaatgtcttaaggttagtgtttttcttcatatctttcggcagtttaatagcataacagaagtagtgtactgtaagtccacaattaccacatactacctcatagttgtcattgtcgttaaatttttctttgcagacactacaaaaagtccttgcgctattatttgcccatgctgtatcaggattttttggtttattcttagtgtgtttcaaaatcatgtctttctctaacattttgctcggtttattaccatcatggtatttttcaagggcgacagaagtttccttagaatgtgaaataactgtataattgtacgatgccccgtttggttcgtttaacggattacttaacgctatgtcattgatcattttgatcttcttcgttgaaggttcattatattttggcagcttattattcactaactttaagctattccgtaatcgctgaaatgttttgttatcaaatttgacaaatttaaaacctttatctacagacactgaaccagaagaactgccgcctgttttaattgaaatttctatcaaatcattcgaagcattagtgattttaggaatattgttattactagccttctcgataaatacatcgttgcacttgcgatttcggcttgtatcacttgttttgatagtaccaggtgattgtcgaattatgttcacgggaaattcgtcctttgtgtttttcgctctttctggcttttgttcagggatggcttttcttacctctttgttgtcctctataaatagctcaagatctcgttgcatcgtctccgggtgaaactcattctttcgatatgatctcacagccattttgtagagttgcgtgtggaatgtcatggaataccgcttcattttcacaaatgaatttgggttcttgtaaactttcattctttgcctgataattagctctgaatcctgaacaagttcccattctagtagtttattatgagcttgaaagggagataacgtaaacttgtttgtgttattctcctctataatcccttctatcgctgaataaaaactattctgacaggttcccgttatttttctcaatgtttcaagcggtggtacccacttaattgcgtatcttcgccacatacgagcacaacgaatgcaaagagcgccaagtttttcattctttttgctatgggcaggcgatttctctgaaatttctgttttttcgttgactcctgtctgcattcttatcttgatcttttcatcatctgaacctccagtaactctataccacatcggggagtaatctgttttacaaaacatgcattggaaggaggattctgctaaagagagtttctcagtatcaaaagaagaatcatctatatactttgtctctacgtcattttcatgattagcgatttctttttttcttttattctttgataacttactcaatttccctctcacggtaaggcctctttcagtctttttccaattgtaataaaatctaacaatcatcgacataggttgagtgcccacatactcacacactgggcgtaattcactcccaaatttctcgacagcttcctcaaactttcggatctccacggcggtaaaacttggctctttcaaaaattttctggaaagctcccttttacattttttaaatgcctctgctgtatcataatttgtaaataataaattctttaggactacatcaatgaaattacaagtctcacctctcacattgagaatagggcatatttcgcttttgcattgttcaatatattcactcaattttcgagtagtaatttttgatgcatcaagtacccatgctagttccgaagttttcgttgagcctcgctcttcttctgaatttgcacttatatacgagttccgcctccagggcacattatgattacatccgttccattgatacttcactcctaccctagagggtttgaaaggatatggaaaaaacatagaatcatttaatgcgtcaccaatatgagaaatggaatatattcctaagtattgaaaccagcaattttcggtattataaccaacattctctttgatagctttgctagaaatttcttcaattttttgtcttacagagcgaataaaatccagttccagtgcttgttcttctagaaacctaacatgcgagtccttagtaccttgttgtttctgtaagcaactgaagcaggtccaaacgacgtctttgttcggcttcctgtcaagtggcggatccatacagtatagatgtgcacaaacgccgcattcatcacatgaaaggctctccttttggatacaccattctttacagaactgacatcttttatcccattggtagtctgcaggacttaattcgtttacctctagttcatggaaaacgtatttcttcaaaacgttctccaatggatacttcggttctgtatagatataacgaaatctcctattcaaaacataaagaaatggcgacttactgttccatttatttaatattttatccgtgctgtaaactttgtaatatttcaaagtatatctgtcaaaaagttcatcaaagtaaaagatattgggtcgtataatgcattccttctcattaggaagaacatcaaaaacttcgtctttatgaaatatactacattttcccctgtatgatgaaataggacatatgtcctggtgtaatgatgcatacaccaaccttgggttaaaagtatttacgtgctcttgaatatccctaggacgataaaaccaattcattctaacttgaaaaaatttagcagggaagaccgatgttgtctttatagcttcatgaatagtgttagaaaattctggtttactaacaaaatttacaactctgccaacataataaggctcgccagcaggctctgatatcatataaatagtgtcgttcgcagataaaaggacagattctgtattgaaaagagacatctttttcaagtcaatcatggcatcatctagatcaagtatgttagagaatctgctattctttctgaacgaagggggtaatgtagggataaagttccagcaagtattcttatcatgaaggaatttttggtacttgaatttctcgtttctactagctggattgcttgtccttttacaattcctgggagtttggctattgctacccttggtcttagcaccacttttttccgctatttgtatttgttgaactaatttagtatctatttccatttcattataattcacgtttttagcagcctctcttcttctaggtaattggaaatcttcttctttaggcatagcgtgaccagctgaaaggcagatgatctcaatatgtcccgataggccaattttgccaccagatagttcgatggcattttatttttagtccttttgaaagcaatatcataaaatatatatagttctccatgatgttcgggtcagtcgctccgaagcgtaacctagtataataaatagttcattgcagaaaataacgaaagaaatggtggaatacgatctgttatatctaaactaaagctaactaacggaataagcaaatacgaatcgaccgctaatttaacaaatatggttttagcaatggaaagtagagtggcaccggaaattcctgggctcattcaacctgggaatgtcacgcaagacttgaagatgatggtctgtaaattattgaattccccaaaacctacgaaaacattccctggttcccagcctgtgtcctttcagcattctgatgtggaagagaagctgcttgcgcatgattactacgtttgtgagaaaacagatggtctgcgggtgttgatgtttatagtgataaatcctgtgacgggtgagcaaggatgctttatgattgatagggaaaataactattatctggttaatggatttaggtttcccagattaccccaaaagaagaaagaagagctgctagagactcttcaagatggcaccttattagatggtgaacttgtcatacaaactaacccaatgacaaaattacaagagttgcgttatttaatgttcgattgtcttgctatcaatggtagatgtctcacacaatcaccaacaagttctagactagcccaccttggaaaagaattttttaaaccatacttcgatttaagagcagcgtaccctaatcgttgtactacttttccgttcaaaatttccatgaaacatatggatttcagttaccaattagtaaaagttgctaaaagtttagataaactaccacatctttctgatggtctgatatttactcctgtgaaggcaccttacactgccggcggaaaagattcattgttattaaaatggaagccagaacaagaaaacaccgtggacttcaaattgattttagatatcccaatggtggaggatccttctttgcctaaagatgatcggaacaggtggtattacaattatgacgttaagccagttttcagcttatatgtctggcaaggcggagctgatgtcaattcacgtttaaaacatttcgaccagcctttcgataggaaggaatttgaaatattagaaagaacatacagaaaatttgcagagttgagcgtttcagatgaggaatggcaaaatttgaagaacctagaacagccattaaatggtagaatagtagagtgcgcaaaaaaccaagagactggggcgtgggaaatgttaagattcagggatgataagttaaatggtaatcatacatcggtggtccagaaagttttggagagtatcaacgattcagtttcattggaggacctcgaggaaattgttggtgatattaaaaggtgctgggacgagagaagagcaaatatggctggtggtagtgggagaccactaccgtctcaaagtcaaaatgcgacattatctacctctaagccagtccattcacagcccccaagtaatgataaggagccaaaatatgtagacgaggatgattggtcggattaggctaagaagtgttcgtatcgacatatatcggtgtaagaattttgtgtatgaataagatagaaaagcaaaagcaattgcttttgctaaattaattcagttagttatctatttatatgtacatgagaaatgggagaattttgagaagcgagggtgaaagtgttatatacgcatatacatgtatatatatgcgcatgcttatcacctatgggaaaggactaaacttttcaataattctcttgggttaccgttaccacttaggaaatatttttcgtcaatcaagttctcccacttttttcctgtgatatccttgtctaataaaacatttgattgtttgtagtaatcgattagttcgttaacttcctgtttgttcagtttaggaacctcgaattcggtgacattacctttttggagcaattctacgaacttcggttcatagtgatatctagtaacataggggtctactgggatcttgcccaatgccacgggtaaagttttgtttgtcctgtcaacgccggatatagctaatatagtagaactctcaccattagcaaatttcgtttctcctgaaataatgtccatcatcaatttacccatttgtaaatccagggaatatatttgtttattctctgtatttctgtacgcagaatatgcagtagttaacacttttgaaaaattatccactgtaaacatgattggcaccttggattggacagataactcatcaataatggctttcattagttttccacgattatgcgggtgggtcattacggataacaaatctaaaactgtatttttcgttttgtttaatgtgacaaatggttttacagaggcattctttgggtttgcattcgagaacttgtagtctttggatagctcaatagattttaacaatgcagggtcatttgccttcaatattttccttataagctttttcaaatacatcggttggatgaaaagctttaaatcatcatcataagaaaagtcattcctaccgttcaggaataattcaggatatgatatgttaataatgatttgcttggaatcaactgcatatgcatgcgcttgagagagtagtacagttttcccgacccctggctctccagtgattataaattttttaacaggatgagatactagtttcttcaaaaagctattcgttgcatcttcacgaactagacaaaccggtttttgaaaaagttcattgaactgcgacttcttgaaggaacccaaatggtgaagggatttgtactgtttgttggaatatgatactactttattcaaagtcttggaaatatcatcaaagttgaagataggtaatgccaaaggaacggcggtctgttgtaattgagcggtgtgcgtggtgtttgtccagtttttatacaatgaaccaggagtaactctctttgcagatgagtaagatgagactgaagatgattttttggaaaatccttgagttttaccttttggtgccggtttagcagcctggagagatcgtgccgtagtgaacagcctttgcccaatgaatcttgaagttgacatacgtagcattattctgatacgtataccacgtggcttgtacttgttctcttgtttatgttttccctcgaagtatagaagttgatgtatatatacaatatacatatatatatattcttgtacatagtacttgctgagtttccttttctttttcttccgttttgtaagaaagccccggaaaatatagtgttccataggataaagaaaaacaggcatacatatgtgcaagctagtcgagtaggataggttcattagagaccagtcttgcaatatcgtcattcagttccgtctccaaattaaaatcagagtagtaatgtagcgggatcaagggcgaaatatccttgaccgtgggtatgaggttcccacttgaccagtttcggaatacgtgctgcgctgtgatgggagtatcgaatacagtatatatgatgattgaatcatccttcgagtagttgtttctttcagagaagtagatgtcgtagatttcattagcacttagcgtgatgaatacttgattgcgcaaatgagataagcagtttgatttattatttgattgcaggaagttgtcaaggacaattctcaaagtagagcaatcgtaatacggatgttgcgaagcattttcttggtcttgtgtgttgagatgtttccagtcaccatagggcaagttgaaatgttttagtttcctgagtagctcgccgtggcgttggatttgcaataaatcaggatgtggtgtggtggtgggtatcgtactcgattcagattcttccagcttttgtataagtttatttctttcaatgtcgtttgttttccgtaggaactcaattaaccagcggtcgtaatggggtctcacgtctgcattggtgaggatattagttgcggtcgataataagtggaatttgtgtataattgatggattgtccgggtgtttgtcaggatgatacttcagggcaagggtcctgtatttgcgtttaatttggggcaaatcatcgtagatggtatggacgtccaggggggtcggtaattctaatacatcatataggttcaaacgttgatttattacgtcttccaattcgtgtcctggcatagtcgtggcgaggcttgtagtacggcgatggacttgctttttgattttgctttcatcttctaatgtcttgcgagataatatgcaaggaaaacaaaggaaagaaaatacaaagtaatgcggcttgcatatatatatacatatatatatgtatatatgtgatatatatatgtgtgtgtgtgtatatatattcatgagtgtataaaatagatatatgaatgcgtgcgaatgtagttataattaggtgtgttcagttggcccatctttctaccatttcattcatccattgcgggccttgtaattgaatgatcttgggcagctcgtctagcccttccagcaggccatcttcattaacgatcgccgactccatgaacccgttcaacagctttaaaatgaagagacagtttggatacacaatgcattgcgaataaggggggttgcaccagtactccaggtatttcaagtagtttttgaagttaggagacttccagatctgctgttgagtgagtaagtacgttacgtattggatgtttgccagtgactggataaattcgagctccacttcgaacctcgtggggagaggattttgatccgaggaaggtgtcgctggtgcgtttccattagtgcttgacatcctgggtggagcttgggggaactttgccgtcttatgagtgctataagttttggcttactttgcctcatttttcctgcatttctttttctttttcatcctttaagaacacgttagcgggaaaaccgtgaaataaaatacaaaacgaactgttcgaaaaaagccaaaggggaaacgcctaaaactccactgaaaccagctataaagcacggcatattacaacaatgtctagcaaatggtttaatgctatacacctactggtgtgcccgttgacggtactggtaggatatctcatgaacgcgtatggctacggtgcggcgctgcaagcaaccctgaataaggatggtctggtaaatgctatgttggtaaagaaagggtggttttggacttccttggtcggatggtggtgtattatacgctaccgtgcggtgccgggggcaaccggcagagaccgaagacacattgtccagtcattcaaaaggtatgccatactgacagtgtggtggtacgtattcacgcaaggtatatggtttggcgtaggccccatcatggacttggtattcgtatatacgggtggccattgtcactatgacgtcttcgatgatgcaggtcacgtgaacgaagacttccagggttctgtcacccggactaatcgcgcgttggcgctcattcacaatgtcctcactttgcacggacaccaccaagaacaccgtcagcaacaactctgggaccgctccatagggtcgatccagggcgccctgcaggcgacgcaaccgaaaaccccaaaaaacgtaacggccagcgctgccgctgccatcaatacttttattcatgaccagatgcacaggtggcaaggtccgttaaccacctcggcacagtgcagacgttttggaggccattgggctggaggacacgatccatccgggcacgtgttcttggccaccttgatgtgcatgtttcttctaggtgagctacgtgtgtttgggcgtcgtgcactggctcacttgtacgcgcagaaatggcagcttgtacgattggtgacccgccttttcgacactggaccgctatggacgtggcggcggtgtggcggcggctcaatgacctgtggcgcccgtttgtggcgtgcgatagtcgagccgcctgtcacgtgcgcggccgccctgctccgtttgacgcgatgcatagcatgcgaccacccagtaatcatactgctgacgctattggtcacgtggttatggcagctgctgttgactgcggtggcgtcccgtttccacaccgtacgtgagcacatgtctggattgctagctgcgtacatagtgacaggccttgtctacgctcgcgacgcagccgcgctacgtccagtatgactcaggaaaagttggcgatagaccacgagcgactgaaaaaataacagcgacttttctcccggtagcgggccgtcgtttagtcattctatccctcggattatagactgtgaatattgcatatgcaactttgactcaaatttttccaaaatttgatatatatatatatatatatatgtttgtatgtatatatatatatacgtatatatatcatatatacgaaaagtagaaaaaaaaaggtgatatttcgctcgtggaaaagctaatgccacagcttgtgtttcgtgtagtttgccttgctccccttgattgaaatagtctccctaaactaaagttatcagcaaacagaaccaccacagttactactacaaccacatcgcaatatgaagatcacagaaaaattagagcaacatagacagacctctggcaagcccacttactcattcgagtacttcgtcccgaagactacacaaggtgtacagaacctgtatgaccggatggaccggatgtacgaggcttctttgccccaatttattgacatcacctggaatgcaggcggtggacggttgtcacatctgtccacggacttggttgcgacagcgcagtctgtgcttggtttggaaacgtgcatgcaccttacctgcaccaatatgcccatttcgatgattgacgacgctttagaaaacgcttatcactccggttgccagaacatcctagcgctgagaggagatcctcctagggacgcagaaaactggactcccgttgaaggtggcttccagtatgccaaggacttgattaagtatatcaagtccaagtacggtgaccatttcgctatcggcgttgccggctacccggagtgccatccggagttgcctaacaaagacgtgaagcttgatctcgagtatttgaagcagaagatcgacgccggcggcgacttcatcatcactcagatgttttacgatgttgataatttcatcaactggtgttcccaagttagagctgcgggcatggacgtgcccattattcccgggatcatgccgatcactacctacgcggccttcttgagaagggcccaatggggccaaatctccatccctcaacatttctcgtcccgattggatcctatcaaggacgatgacgagttggtccgtgatatcggaactaacttgatcgtggaaatgtgtcaaaaattgctcgacagtggttacgtttctcacttgcacatctacaccatgaacttggaaaaagcgcctctcatgattctggaaagattgaacattctacctacggaatcagagttcaatgcacatccattggccgtgttgccatggagaaaatctttgaatccaaagcgtaaaaacgaggaagtcagacctatcttctggaagagaagaccttactcctatgtcgcaagaacctctcaatgggccgtggacgaattccccaacggtagattcggtgattcgtcttctcctgcgttcggtgacttggatctgtgtggttcagacttgatcaggcaatcagcgaacaaatgtctcgaattatggtccacccctacttccatcaacgacgtcgccttcttggtcatcaactacttgaatggaaacttgaagtgtttaccttggagtgatatccccatcaatgatgaaataaatccaatcaaagcacacttgattgagctgaaccagcattctatcatcactataaactctcaacctcaagtcaacggcattaggtccaatgacaaaattcatggttggggacccaaggatggttacgtttaccagaagcaatatttggaatttatgttgcccaagactaagttgcccaagttgattgacaccttgaaaaacaatgagttcttgacctacttcgccatcgactctcaaggtgacctgctaagtaatcatccagacaactccaagtccaacgctgtgacttggggtattttccccggcagagaaattcttcaacctaccattgtcgagaaaatttcgttcttagcgtggaaggaggagttctatcatatcttgaatgaatggaaactaaacatgaataaatacgataaaccgcatagtgcccaattcattcagtccttgattgacgattactgcttggtcaatattgttgacaatgactacatttctccagatgatcaaatccattccatcctactaagcctataataacacagacaacgataacagttctttaacagaattgtcaaccccccctctttgcattacattcaacattacattgcatttttttttttttattcactattattatggttcttcttttttaccagattttgctccttccttttccattgttttaccattcttttttaactagcatttcaacatgtgtttggttaacaccccttcttttttttcaggaaaatcctttcatttcttctcatactttcaacaaagttttttaaaggtactttaaaatagttcaacaccctcttccttcatttatttattctcttcatattcaacatactcgaaaaggaagaacactaaaagtacttacattttcacatgtatgtatacctatatatatatatatatatactcttatagatatatttacaaattaaaggaaaaaataataaaataacctccctgtcacaagttaaaacacggccccatcacttataaatagtctcgactcgtgtttttgacaccaattagctacttttctcgcactcttgaataaaacccttttgtcaacaatcccattatttccaatcagatacaattcaaaagtgggcgtcacccacgccattcctaccatattaaccgattcttgtttgaatgatgaatttccaataatgtactcatccaattcagaaaaatccatttgtgtttcgtccatcgccaagtcctcattgtctttggaactccatctaacaaaatttaacatagacctacttaacaaattgccattatctctcactaccgtgccatgtaactgttggtagtatgtcttcaatttcaattcatattctagcccctgtgaagaatccagtgcgatgttactgttgacttcgaagtgcggcataacatattgaacgttttgcttcgatttatatatgaaatgatgaaccattggtgctggtatatcgctaagcttgaacccttttgaagtatttatctttttcaatagcttctcttcttcgagtttaataatcaactcgtcactaaacgacttcaatgaaaagaatgcatccttttgtgcacttattaatactagtgccgatttctcattgctgtgagtatcattaggtagaaacttaatataacaataaagaaaaccactcgaattgaacttgggaaaacaaatgggtacccaaagttcctgagtttcgtctaaattttgaaattgatgagatattaggcaaaatagaagatgtaaatctgtagtgtgtaaagtatggcctctgggtcgaagaacacagcacaatttattctgaggcgcaattatcaagccgtacagtaaggtccccctgggaatgtcctgccttttctccagttgctgtaaaaccacattctgcaactttaatcttgaagaatggttaaatggtaagcattgtaaagagttcaatagtaaatccgggaacattctgttacagattagtgaacatatttcgtctaaattttcaaaatctgtgctttctagataatttctcaggtcgaaattttctcttttggaaaataacctaagtaattggcgttcacttaaagacgaaagaatatacgaatataaaaaatccaactgattcaacaattcgttcgaggactcgcctctttcggattgagccattagtaatataggtgatttatccaaaaaagtaagccttttaccagaagttaaagtggatatagttttcaattccgatggtccattgacttggaagtagcttattaccgtattaacgagccctgtatatgacatgatctgttcatctttgccgtgcatgcaatagatcggtttacccgctgacgtgaatatgaagaaatttttgtcacagagagtctggctctcatttaacttgcagttactattgaacttcgaaaacttgaatacattaggaatttcgttacttacgtacggccgtctctgtagttccgatcctcttatagatgtttccatagaatatatgctttcggccaagcgactcctgatgtcattctcgctgtccaaataaggaccgaaatccttttttggactgtttagtgctctcgttgtatcatcattgctctttgccaaatctgctgacaataaattatttttagcttgcaatttttttgtttgcaaaggagatcttctggatgccaaagatgttgtattcaaagaatttacagaggtagatttactaacagaatgatcatcgcatattggcattgctataggcgccttcttgaagaatgtttcatctagattaaccgatgtcgttggttctgaagtcgttgccacgattggaataccctcaaaattcccacttttactatgcttcaattgacccttcggtatctcagcatctaggtagctttcattgagattcatagttccgatgtactgattctacgtttgtgtactttgatagacttttttattcaattcgtattcactactatctttgtctcgtaccgcggtttttatcctttatttcagccctacgagatagaacgatggagcctagtaataccattttatgtaagcaaaataagaagaaagactaaaagaattaggatatgttgttaatcagggataaaggtacgcatactagccttactacgtaaatataaggttacggtttacgatcactattgcaagatactattgtttagcattggcaaagacttgacgggaaatctttgattgggcccaaccatattcattaaagatccgggatgtgagcttgaactgcttttcgacgcgaagaaggtttacacgtattttagtaattggcttattcactaaggattcttaaggttttcttaatagttttctacgtcggcatgcgattgtttggtttagaagactgctttctaaatatggttgggtgtatttaagctagacccatacacccgctctatgggattatttacttgtttgaattttaagatttgtgataatggaactggacgcaaacatttgatggaaaacgcatgtcatcattaacgaggtaacgtaggtatctgtcctgccttagtattgcacgcagcttcccaggacgtctagctattttttcatctattcccctctgtagtaacgtaagagttttcaagtttttaattcagactttctcttcctttgtttccaatttccttccttactgcttgataccttttcaatcccaaagaaaccgtgttctttatatattgtcgattgaaagttacctacatcaactttccgtgttccattccgactataacaaacaaccaataagctcaactaattaagtaatgtctgctccagaagctcaacaacaaaagagaggtggtttcggtggccgtaacagaggccgtccaaacagaagaggaccaagaaacactgaagaaaagggatgggttccagttaccaaactaggtagattagtcaaggctggtaagattaccaccattgaagaaatcttcttgcactctttgccagtcaaggaattccaaatcattgacactttgttgccaggtttgcaagacgaagtcatgaacatcaagccagttcaaaagcaaaccagagccggtcaaagaaccagatttaaggctgttgtcgttgttggtgactctaacggtcacgttggtttgggtatcaagaccgccaaggaagttgctggtgccatcagagctggtatcattattgccaagttgtccgttatcccaatcagaagaggttactggggtaccaacttgggtcaaccacattctttggccaccaagaccactggtaagtgtggttccgtcactgttagattgatcccagccccaagaggttctggtatcgtcgcttctccagctgtcaaaaagttgttgcaattggctggtgttgaagatgtctacacccaatctaacggtaagactagaactttggaaaacaccttgaaggctgctttcgttgctattggtaacacatacggtttcttgactccaaacttgtgggccgaacaaccattgccagtttctccattggacatctactccgatgaagcttctgctcaaaagaagagattctaagcttgttgtctacaaattataaaatagttttttataatcaaccattaaataattttgtacacttataataacactttatttctcgttccaattatgcgatgcatgtgccttccgtttagagtgagcattatcaaatataaagtcaaatccttttggcatttattttgattgaaacccagtctgtccttaactcttttgcctatcaaacgctgtaggtcactcttggtacggtacagcggatagcgctatttattcagcaagagaagcaagattaggcgactacaatagatcaaaattttacaagtaaaacaagtaggaacaatcacttatgcaaatgattaatgctgatatgtttatttacatcacagtgcccttatgatcaggaactgtttaaaaacttttttttttttttttttttttttttaaaatctaaatatgttgcttgaattataaatacaataacgggaaaacatatgatgtgtcatgttcaaaaagctttgaataggtgtcttccatcaaaagggtcacaggaacatgaatttcgttccgtgattttaatagtaatcagttcatttccgtatcttgttcttggtgcgtaaaactggtttgcggaggagcattttcaattattgcgttttctggcaatgcaaatggcctttcattggtaggaacgtttgaattgggtgcagcgcctttcttttccggaagtactctgcctggaggatgtctgaatagacagtaaatattcttacaattgacaccaaatctacaatcttcattaattggatggccaaataaacaatcaattctagtacagtttgctccttcacggcacataatatgagaacgagcatgtctatatttgcaacgtttattggtgcagtgcgtaccgaacttacattgttctaaggacttttcaaccggaggtggagctgctttcttctggcttattggttttacttccttgatcttcgacaatgaagagtgggcctttctacactcaggattatcacatgtcaaattcttgtcacaccacattagatcaatgactttcgcatcttcatttgctggtgttggatgaccaaatgggcatgatggattggaacacagagccccaaatttacacagaacgataccagtttgtaccggtttcctttttgccgccaataaatcagcttttcttttttgaaattcttcacgagttctttccatttccttcatcaactcttcatcttcatttggatgtaaaaactcacaagttccgggaggctttggacaatttggatattcattacataccttagttgggtgtgcatgtgggcatgatctaccaagaggacagtgaggaaacaatctgcaacgcccctctttcttggttggagtgaagttcatattactctcacccgccattccaagtgcttttgctaacggattaaaacgtgtggaattattgttgcgtcctccacggttcccaccgcgaccacctctacgattctttccaacggcgcctccgccacgttgagtgaacctttggctgttatctacaggcgcaaactgagggggagctgcagcgttaacaacgccggaaaaggctgatatgggggatggagttgcaggagcatctgtctgcattgcattctgggtccctagttgtggctgaagtggttgaagttgaggttgctgttgaggttgctgttgaggttgctgttgcgcgatgtctggttgctgttgttgttgttgctgttgttgctgttgtgcgatatccgattgtcccaagctttgcgcattcatcattctaattttggaaacaatattttcagcactttctccctgttgcagagcttctaatgcgaaaaaggctgtttgaacaacatttgcaagcgtatctctcgaaacactatcaaacaaactagccagctcgtctacgacagattcaacagtaccaccgttaacgatcaataagacaatatactccgcaacatacttgatatcttcgttaaagtttggtataccagccagtttttcggcaacgataaccttcaagttttctgtgtactgttcttgagacatttctgatgtacttccacttccttatgatcagagataattagaaaccactatatttagatgttttatggaagtatttggaagaaagatgtgtaaaattttgtatttttcccatttgccaccagcgaagcgaatatcactatttccccgcttcgtattttgtgtaacgatgtacgagaatacaacaatgtttatataattgtatatgaatgttctcttcacattaaactctgtgtataaggtcgcgttgagcaagctagtgatagaaccttctcctaggatacatagaaagagtgtcatcagttcttgttagctcttcttgtaactgtgtgaacaaatcgtcgatgtcccagtccagttctgacattttcattgaaagcacatccctatataaacgtctcgcctggttccttttttctagcaaaagtgctaacaaagatggcagtgttgtggcagtaacttcccttgattcaggctcaattttgtaatgaaccacacgatcggtaagtgtgtgcaactctccgacaacggtgacgaggttttcttgagtattggagaataacaaaacttcccagaaattataagttggttcagccccagccgaggcttcttcctcgatgtcacttagataaaacatgattgctacttaaaagatttcttatcttctctgtagttcaaattagatagtggaaaataagttttcttaatatacagatatatgcggtttaccccaaaactactttgatgggaagccaacatcctcgttgaaattgagtgattaatttcgttgcaagagtaagatgctcgttttaagcatcgttaaaggagtaatttacctttacggtaatctttgccatttttaagggaacttcctcacaccgcggtttgtttctttatttgttcttgtaaaaacacctcgaagggaatataggatgtgctctatatagacatacccaacaaaagaaaaaagcttctttttgatacagggcgctatgattttagtacaagcagctttaggttacgtgtacctatttctagttgaattttctctctatgaaatagtcctataaatttatataaatctatttttttttttttttcgacacaaaatgtctatttcttggagtgcttactcttctttttgtttttaccttgtttcaactcgtttaatctatcaactttttccttgatcctttccaaagataatttgacatcacctttttggaaattgcttaagtcgtagtatgcaggcgctatttcaatcagccattcgggcctgaccgaggtcacagttcttatgtagttcttcgatgtgagcacaaattcattgtaaatgacccattctgcgtcgtggccaagaaccgtactaggatggatcagaacatcttggttatctttaactgtgatgtatcctttagctcccgatcttttttttgctacttgcatgaaaaacccagacgcaagagcctttctgatgttgtcaaagtatttagggctttcatagtctgtagtgtttaattctaggttgtaacggttcattaatctttctaattgggagcggatattatcagcagcggaaagggacctgtaatttagatagtggtcacggcaccacttatggataccatattcataagcttcatccgatttgaacgcatgatatacatttagtaaggtgatatgatcaccgtctggatgagcaaagatattcttggcatcatctgctcgcttcttgtcctttgttgggcgaataaacacgtttggaaccgatagcatggccactatagttagtatttcttgagaacattggaactcaaaggacccaattaacatcaccgctagcataggatccaagggaaactgggatgccaatctacctaggggtgttaagttaccttcgtcgtccagacatgccaaataatttagttcttcaagggctctcatcattgtttccggagccggtggatccataaaatcgaaatggaccaagtcatcaatacctaatttttttagttctagaacggtggaggataaattggaacgtaaaatttctgggtaactttgctctatcagttccttttggaatgcctcttcagtgtataatctgaaacatttaccaggccttgtacgaccagcacgaccagctctttgttgggcagaagccttggagataggggaaacaagtaaagactcaactctaattcttggattgtaaactttttgctttgaaaatcctgggtcaacgacgtagacaataccatcaattgttaaagaagtttcagcgatgttcgtggagataacaactttcctgcctggtctaccattatgtgactctggagcaggctcgaatattctttgttgttgatgcggtggtaatgaaccatacagtgggtatacggataaaggtccgcatccctcttctctaaccaattgatcaccttctaaggaaatctttctgacagcgtcttcaatttcatcttcaccagttaaaaataacaaaatatcgccagcctcttcagtggcatgaatttgcaaaacagtacgaatggcagaatctaaatagtccctttgaaattccggtgtatagtatagctcaactggatatgttctgcccggaacggcaagtaatggagcatcgttgaagtagcgttggaacttctctgcatccagagtagcagacataataattatcttcaaatcaggtctcctcttgactacttgcttcaaaagacccatcaaaatatcagtagctagtgtacgttcgtgcgcttcatccagaatgatacatgaataacgcgacaagtcatggtcttccattgcctctctcaacaacataccatcagtcatatacttcaatatcgttttattagaagttttattttcgaatctgatagaataaccaacttcttcgcccaacttgacatccatttcctcagcaactctctgtgcaacagacattgctgcgacacgacgaggttgagtacatgcaacttgagtgttctctaagtgtggcatctcatcgaataaaacgaattgaggaatttgtgtcgttttaccggaacctgtttcaccaacaaaaaccataatctggttattttgataaagttttaaaaactcatctctctgggcatgtactggcaattctcttctaattttcaggatatcaacatattttggtgtaaactccctaccggtaaatggatttatttttccatcttcaagtttttgggcctcttctgctgaagtatggtgacgttgcaagcccttgaattcaccagcatcatgatggacaagtggctcttcggatggaagaggatgctgtttggataattcttccgcaatctcggcggcctgctcaggaatagaggtctcaactggatccgggtgttcggacgagaatcttcttttggaacccattattattcttgcagtcctaatctttctatgcgcgtttataaggttatactatcgttactcaatcgcatccccgtaaacgtgttaaatattacaattgaataagtttcttttcacctcatctcgcatttgaaaatttttcagaggcaccgaaaaaaaagaaaaagaaataaaaaaggacttgtgtataagatcgctagatcaataaaaagcaatctggtagatttatgggactccgaaatgatactgtcagttgaaacagcaaacgaatacagagcgtaaaactaaacgaccttagtttggaaaatgatgaaatttgtccataactatatactatcagtcagcaaactatgatccgggtaatattcatttgtaaagctttagatctgtaatagtacccagtacttttttagatgatcttaattagttaagatctttctggtactgtactcagtacgcttccttggcatccttattgggacctgttcggctaagatatcgttcgatatggttacaaatatggtgaaattgaggaatttaaggagattgtattgttcatcccgtctcttaagaactatacagaacgggagaatttcttctgtttcttcaatatcgttgagtaagaaatatactacaaaatctgccaaagaaggtgaagaaaacgtagaaaggaagcatgaggaggaaaaaaaggatacattaaaaagttccagtgtaccaacttcacgaatatcgagattgttccattatggctcactggcagcaggggtgggcatgaatgccgcagcaaaaggcatatcggaagttgcaaagggcaattctcccacttggaaatctttgattctatcagattcgaatattgacagaattaccaataaattttctaaaatgagaggtgttgcccttaaaatagggcaactattgtcttttcaggatgagaaagtgttgccaaaggaattatacgaaattttatcaagggtacagaatagtgcaaatcatatgcctcaaaggcaattggaaaaggttatggccaaggaattaggtgctaattggaagacaaagttttccaaatttgacaagatacctatggcagctgctagtatcggacaggtacatgcggcagagttgcccagtggtcaaagagtggttgtcaaaattcaatatcctggggttaaagaatccattgattcggatttgaatagtttactaatgttacttacagcctcaagtttattaccgaagggattatttttggataagacaattgccaacgctagaactgagttaaaatgggaatgtgattacaacagagaggctagagctctacaaaagtttgaggcgttgctaaaggatgacccagcgtttgaggttcctcatgtgtttcctgaatatacaaccgataatattataactatgacacgtatggagggaactgaaataatgaaattgcccaaggcatcacaagaaaccaaaaattttatttcggagaatatcatgagactatgtctggaagaaattgccactttcaagtatatgcaaacggatcctaattgggcaaatttcctctataacggtaggacaaagaaaattgaattattggatttcggtgcctccagaccttttgcagaagattttattctaaaatatagaaaacttttaacttacgccacattgagagataggaaaggggcgtacgaaatgtctgtacaactgggctatctcacaggcttagaatcgcagtccatgaaagacgcgcacgtcgatagtgtacttacacttggtgaaccttttaggggtgatgtagataaatctttcgatttcaaggatcaaacagtctcagacaggattagaggtaatatcgggttaatgttgaatgaaagactatgtccgccaccagaggaaacatactcgttacatagaaaatttagtggcatttttcttttgtgtgcaagaatgggtgcgtctgttcattgtgcaaagctttttaaagagatttttgcctataaagtttaaaatacttccccgctatttgtatatatgcatatctttatattatgaaagatatttttttatttacttttagtccgtatacttttattttgttttgttagacaatctcgaagaacaaaaaaaaaagataaaacagaaagataaatgtgcactcttttgtacctcgttctgctatagtacttccaaccagatcgactgaaagattactagtatatacgtcatgtttttaaatagtagttcccattctgcttcagtgaattagatatttttttccaatcattctctttaaaccctctgcgatagtgatccaacattttcttagcaacgctaatccttctgccaatagcttctcaaaatatacaccattaactttacaacattacataatatgacattccacagaacctctctattccattttaccccatttcaaattactttttagtctttgaattgggtcgcttcctaattatagaattatttttctctgtaaagtcccagccttgttacaatacaattgtacatcattcatgagagatgaatataatctgcatttcttgttctaaattgaatatgtatctttgaaaatactctgtatgcaggcaacttctttaccaatatttactttatgaaacacgccagctttaagacaataccttcgggtcagaaatatagtttagtttgttaactacagcagtttcttacagaaaattttgaacttcgacattagtgcatttatctcaggatataatgatcccgttatccaatcgatatagcttcctcaggtttccattcagtcataaatgttaaattaacgttgtgcctagggggcagataagcctatgacattgtttcgtgctcatcaaaacactaatgtaatggatggcaactgttgcacctattcaggctgcaaaaaaagaagtatcatttaaatcaaaaggaatatgaactgatataaaaagaacatattcatacgggcgaatttggctagtaaccattacgagataggatagaatatacgtatgagattagaataattaacataaaatatgataatatcgctttgcattgcaattagcatacgtaacctcacacaaattttatactaattgtctaggcatttcatacaagaataacattagcgatcattagatcagctaaagttctacataaatgctgctgaacataataacataggtccgcttagcaatatcaagacattattaccgctgtcaacatttcttgtccgtcagtggacttacaagaattgaaccgaaaaaaaaaagaatagaaaaggtacaataaaaagcaatcggtaaacgcgacagcagagacgcccctgcacatttagtacaccgtttccttcatttaaccatccttaaattatcacttgcagtataaaaaatgaaacggacaggaattgaacctgcaacccttcgattgcaatcttattccgtggaatttccaagatttaattggagtcgaaagctctaccattgagccaccgcttcatcttgaaatatccaagaattaaattcttacttgtctccccgaaagctgtatctttaaaacggctcctagttatcgtcagttttgataattagtaactagaatatagtatcaccaagaacaggccaggtaatatactagaagttgtgtataactactaatatttttatacatatagatgccaagtcaaggtccaattagtagatttttcactctaccttgcattattacctgaaagatcgtttgtgtttccttaaattcgccagaggtgcaaacgaatgtaaatatctacatcaatttacggtttcacgcccgtttcgtttctaatggcaactcatgtaaactgtgataaacccgttatttcagttttattttctgctagtataaaggatgatagtagccatttcgctggaatatgtatcgggtttaaaagatggcatagttcgaaacattttcgcacaagattctaactgtcttcgaacgtcgtagaaaccgcaacgcaagaaatgacagcgcaataaaatttattttactaactgatagaacaaatgtaaaaaatttcataatatcaagtagaattctttattctctttgtgaattcctaaacccatgaaagggacttgtagtataagctggatacctattttcattggcttcgtttccaaatgacacaaaaccatcacaaaaggaaatagtccttccatagttacccaatcattctgttgcatattaaatgaacagctccttgttgataatgccagtgtggcatattcaccgctgcagttatttcttttcatatataatgagtcatttgtttctgtcatcacttttctatactttctcttccccgcgtgttttccgtacaccaacaatatatgccataatacacgtaacatttttttataaaaagaaaaggtaagtgatatatataaaatagcgccatgagtaggaaacttttctgttactgcagatatgtgccagactggctcaggtggcataaacacagattaatagtattggcgttgctgaaataagaagatctgtaacaatatcttacaatgcagccaatttcaataaaagatgtggaaagcgatcaagggaaagtttacattgttaatgccttaaaagatctcgtatgcaagtgccttttagaattcgtggacattcaaattgaaagttttatgtatccggacgatccaaagtgttttacaaggatatttaaagggaacaagatagtcaacgaagcatcagataaagattcgaaagtgagaagttacccatcttcattgggtgttggacactctgctttgtttcctttgatatacataagacaaaaaaccaactccttgcggtttttgaatgatccaaagcaattaccaacaccactggtcgatgatatgaacgcaaaattcaaaggcatcattaaagtttatgaaaatctcattcacttgtaccattcatatcagacggtggattgcaataacatgaatcagcaaaagcttttgggtgatctggtcagtcggggtaatttcatgcttgatatcctccacgggtatgttactattgcatcaacaatagtacgggacagtaaggatgccaatatcttgatagacactgttaatcggttcatccacgataccatattattccacaagcgcataatacataattccaacgcttacacagagtaccatgtaatgaaacgtggcatgcaaagaaaccagagtgaggaaacgttagttgaacttgaattccgaatactggatgtttctgatgttaatctggacaatgaatttgatgactttttacagcatagaaaaacgtctcttaaaataactcatagaagggttatatgataatttgacattcataatattggtaaaaagtaccctacatactacatatttctagaatatccacaaagaatgtgtcgttctttttctgcggttctttgttagctttccttcacttcctttatgtcctctttcatgaaagtgaaaaatgtgaagtgcatgcgatttttgcgttagcaatttgattgccgaaagaggcaaaacgtaaatagggttggtttcaaataattagaaggagcatcggaaaaatgcaacgagcaaaacctctagcaggcaaagaatttatcacctttaaaatagactggaatttgtcatattagttcctaattcagccaattaatagtttaaatcagactaaaccagagatcagtcatcaagcttaggactaatctgctttgcgactttgatttttgtgtccaattggaaagaaacccaaaaatatagaaatcgtccattcatttagtgcagaaatatcaaaagacaagtattacaaagaagactaatgccagaaagctctagagataagggaaatgcagcaattagcggtaaccgttctgtactttctattgcgtccccaacaaagctaaacatactatcttccgattggtccagaaaccaaggtaaagtttctaaaaattcgctaaagagatcaagttcactgaacattagaaactccaaacgtcccagtttacaagcctctgccaattctatttattcaagacctaagattacaattggggcaccaccgttaataagacgagattcttcatttttcaaagatgaatttgacgctaaaaaagacaaagcaacgttttcggcatactcttctcgttcatatccaacaattggatctgagagcgtagtttcccaaacatctttatcgcaaccgacaacatctagagaagttgatgagcaatttacagtagctgcggatagatatattccaattctacagggagcttcgcaaaacaaggtcgatcctgaaaccttacacgaggcattacctccgccaaacgcgtcgccaatttcacacttaagggcccagactaagattgtcttcaaacaaaatgtagctgaagcgtgtgggttagatatgaataaaagaatactacaatacatgccggaaccaccaaaatgctcttccttgagacaaaaaagctatatcatgaagaaaagaacacattatagttatcagcaggaacaaaaaattcctgatttaattaaattaaggaaaatcaataccaatccggaaagaattcttgatgcacctggtttccaagacgacttttatttaaacttgttaagttggtccaaaaaaaatgtcttagctatagcactagacactgcattatatctgtggaatgccaccactggggatgtttccctgttaacggatttcgaaaacaccacaatatgcagcgttacgtggtctgatgatgattgtcatatctctatcggtaaagaggatgggaacaccgaaatttgggacgttgagaccatgtcattaattagaactatgagatcaggcttaggtgtccgtatcggttcattgtcttggttagatactttgatagctacaggcagtcgtagtggagaaattcaaatcaatgatgtcaggatcaaacagcatattgtatctacatgggcagagcacacaggcgaagtctgcggtttgagctataaaagtgacggattgcaacttgcatctggtggtaatgataacactgtaatgatttgggataccagaacgtccttgcctcaattttccaagaagacgcatactgctgctgtaaaagcactaagctggtgtccatattcgccaaatattctagcctctggaggcggacaaacagataaacacatccatttttggaacagtatcacaggtgcacgagttggctcaatcaataccggatcccaggtgagctctttacattggggccaaagtcatacgtcaaccaatggtggtatgatgaataaagagattgttgccacaggaggtaatccagagaatgcaatctctgtttataattatgaaacaaaattcaaagttgcagaagtagttcatgctcatgaagcaagaatatgctgttctcaattgtcccctgacggaaccacattggccacagtgggaggagatgaaaacttaaaattttataagatatttgatccaagatgtacaggaagatcgagagaagacggattgatggatggtatgctaggacttattggcaaggaaggttgtcgaacaaatgataaggagaatcgttccaaaaattcgagtgagattcatacaaggaggccctctagtaccagccaatatttgatcaggtgataaaataaaaaaaataaaagttcatgtcaaggcatataatgaaatttccatacacgcatacataatgtataaacataaatgtattcaagaagcttaagaaataaaagtaatgaaccttgagaatacatcaagatataactcatcacatgttaaagaacccacacaccacacgcgcgagaactgggagggagagaaatttagcaaataacaaaatttaggccttggaagaaaccatagcaatgcaataatcgttattaacataatatctacattgagaacttcttgggctagtggttttgctgcaaactggaaaattgtatcaatcttttaacgttagctaaacatcttctgctgtgttagcattaggaggaagcgaaaaggaaaatacataatgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgagggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactgaaacgagccgatgagatttttgtgtacatactataaataaatgcaactaataaagtcatgattaatcagtcatgcatacttcatctgaccaatatattttcatcttgcttattttgggtataattcggcggaaattcggttataaagcgaagtgaaaaatcgattagtaatgatactgatgcgatctctgggaggggggaatgctgcatataagggtgaaggaagataatgcaaagccttttgtagtattgtctgttgataccaaaataaattagttcatcaaaaaggtacaggcagctaaagaaaagctgtaaatttaacgccgtagaaggtatttttcgtgagatctatctcaaggcatcattttttttattttcgcaccaagataggaagaaaaagagtcacagtatagaggactaaccgttaaagattctaaatcggtactgtaaatactttgaaatgcctcaatctactccaagtcaagaagtacagcgtgtaccatgggataataaacctgctttgaagcagataacactccgagcaaccatagcaggtatcgctatagggtctctggtgctaacatcaaattttcaatttggcctgcaaaccggttgggtttccatgatgtccctgccatcggcattgttagcttgtgctttctttaaaaatatctggccattaatatttccgaacgacaggcctttcagtgacgttgaaaatgtatacgtacaaagtatggcagtagctgtcggaacaggcccattagcctttgggtttgtcggcgtcatacctgccatcgagaagttccttactaacgacgaaagtggtggattaagggaacaaggacagtccttcacttttagagaattgttaatatggtccacagccctagcattcttcggtattttttttgcagttcctctaagaaagcaagtaattgttagagagaaacttcccttccccagtggtagcgccacggccactttaatttcagtgctaaatggaactgagattttacaagaggtttctaagtcagagttattggaaatgaggcagaggagattgaatgaatgccctgaagtgctacaacccaacagagatccagaggaggcggattatttaatgaactcttctcatagcgaacttggtgattatacggcaactagccaagatggaagttctatcctttctactggctctgagaactacagagcgaatattattattttattgaaaacttttgttgtttcttcgctttacaccatggtgtcatattttgtaccggtaatacggtctattccagtcttcggaaaatacctctcgaacaattatctctggaattttcagccgtcgcctgcgtatataggccaagggataataatgggtcttccaacagtatcgtatatgcttatcgggtgcttcttaggctggggtgtgttagcaccattggcgagatacaaaagatgggtaccaccagatgctgatgtccacgactgggaggagggagtgcaaggatggattctttggtcgtcgctttcaataatggttgctgacagtgtagtcgcttttattgttgtgacagtgaagtccattgtgaaatttattcttatagatgacaaagctgctttactgaacaacataatcgatgatacatttcaatctatgttactggaggaggaacgcgccattaatagcagcagaagaaatacatatgttgatggaaggcaggacaccgtaagattagtgagtagagataacgaaatagaagtagattcgaagcatttggttcgctataccaccgttatcagtggatgtctagtctcctcgataatatgcattgtttccataatatatttgtttgggatacaagtaattcccctatatgctattatcactgctttgatacttgcgttgtttctatctattctcggtattcgagcacttggagagaccgatctgaatcctgtgagcggcattggtaagatctctcaattgatttttgcctttatcataccaagggatagacctggatcagtgttaatgaacgtggtatcgggaggtattgcagaagcctctgcccaacaggcgggcgatttaatgcaggatttgaaaacggggcacctcctcggcgcctccccaagagctcagttctgtgcccaattgataggggcctgttggtcaattattttgtctagcttcatgtatttgtgctacaataaagtttattcaattccgagtgagcaattcaggataccgacagcagtagtgtggatagattgtgcaagactagtaactggtaaagggctccctgataaggccttggagtgctccatgattctcggagtcatatttgccgttttatcattaatcagaaacacttatagagattacggatacgggtggatattatatattccgtctggtgtagcagtcggtgttggtatatttaattctcccagttttacaattgcaagattcatcggcgggtgggcttcgcatttttggttgaagaatcataggggtgacttaaatgcgaaaacaaaaatgattgtattcagttcggggttggtcttaggtgaaggtatctttagcgtaataaacatgctcttcatctgcttaaatgtccctcactattaggtatataatattttactaataaagaatttacaaagtttacaaattttaaattatttactcatcacataattcgatgtcttagatttccctgtatatatatttctaggtgacaaaaatcctaggcaaaatgttatattatacgcgaccttgaaatatcggctatcttggtgtacaacatggtccatttaagaaaaataaaaaaaagtgatgggcactgttaaaacaggcagaagcctcattcataactgctgaagggttaagatcgtataggtaggaacgatctgacctctcataatggaaacatgggaagtcatagcatcggtaaaagaagcaacaaaaggccttgacttgagcttagatcatccacttattattaaatccgaggacgtgcccagtaacattctccaattactgcaacagaagaatcgacgtcaattgaaacacatctgcatgaaatcaagaaaagagtattttctactagaggaatatgggccaggattttgggttaagtggccgtacaattatttcaatggttacagcttaccagaaaggcgtacggaagttgtaacgacagttgaaagagaaagagctaagcgtgaaacgttaaaaacatgggacgaattgaaatttaaagagcttcttcatttatggtcagaagaacccaagggctcgtgtaagcttgagaaggacaaagaccttaaactggatatgaatcccccagatatgaaaggcgaatcaaaaattaatgactactattcagaccctaaagagtacatagaaagtaagtattatgatgctcttttttccatacatacgcctctcgcatatttcgtcaagtcaaatttagtaaggctcaaaaatacctgccgaaccaagtacggaagtgacagttacaaaatagcctatcaagccatgctgcaaaaatttcttctctcaattgtacaattcaaagatagacatgataacaggcttttattagagcccttttctagtcccatagcagatgaaaaaaggaagaactgtctcacaaaatttgttatccaagatgaaaacaaaaacagctcaaccattgctgatttatgtgttgtattaaaatcccgcgaaataaagctacaaatattattgctattagagataataggattgaacgatttagattggaattttagagattttgagaaaaagtataaattaaaattgaagaaaagatcacttaatttgacaaaaaagggattagttcgtcgaagatcgaagaaaaaaaccagcgaaaaagacaaaggaatcgagagaataacaacatctttggattattgtgaacagttagacttgtacttagatagagcatgcatcttggacattctactatcaagtgaaacgcccaacccagatgccatagaagcatcaaatggaacaatacaagagcataaaaaaaatatcctagacaaaagcaaagaagcctcattggttgggttcataaattatgttcttattccatatttcaacaaaaaggtaccacacgccgttgaatttataattcaaaagctcaagggaccaagcatgagaccaaagagagccctgaaaaaggtcaacgatagcacaaatgtatcgtcacctaatactgtagaaacgtataacaggttatccacgagtcaacgtgcctctcgctcttcaatcattaattccgtcccatcttcacccgcattgagaagggtggacgctaatttgttcagcagaaaatctatagcttcgcccacccctgaacttttgaattctagaacgaactctaacttgaatgaatttctcgaaagtgaaactagaagcttaaagcgcccttcacaattgggaaggacgaagtctgatctaacgatgaatcatttacaaaaacggcagttttctgtctctgacttaagcacaacaagagtaccgaattcatcaactatcacactcaaaacgcctttctcgcactcaactattaatgcatacaaaactatgaataactcttttcgcagagttgggaaacgtaaagatatcaatgaaacgatacgcctacatgaacgtgtagactctgaggaaaacgtacaagttcaagccactcctgctgtgaaaaaaagaactgtgacacctaataaaaaggcgcaacttcaaagcatcattgaatcgccgctaaatttcaaggatgatgatacgcatgaaggcagaaaaaatacctccaatattacctctactcccactaataagcccccggaaaatagctcaaaaaggagagtaagaagacgtttatttgctccagaatccacatagaataagaaactgcgagaccaccttcgctggcaagtagttgacccaactccatctttgtagcttttcttggacgaaaagggaataaaataaaactaagctacaacaatttcgcacttcgggggcctttgagtatacaattaaataactcatcatgcatatatatatatatacatacaatggcgtatgtaaaaactgttatataacattaccgttgtactattagtataaaccgattctcactattcgccaaaaaatatcgcactaattaattcttttgcgtcgtctcttttcaaaatgtgaaatccaatagtgacaccacacctctctagcaatttttccttatcctcatccgtaactttttcacctttaccctcgtacaaatctggtaaatccttttttagaactaacaatgcactaattacagtatcaaccaagatttgagtttcttctttagtaaatttggtcctagttggattggagtcatcgttcaaatgttcctctatattgtctagagttattccgctttcattgaataccaagcgcgcccaattatttaggtttcctaagaagaatctgatggattcaccttctagtaccgatacaccctttaagcacccatagtaagtcccaaaaacacggtttatgtccaaaaatgtctttagcagtgtcctagttactcttggcttcagggatttgtatgcttgaggaaattttttcaatacatagtccaacaaagatgcggcaaaatcacgtagtgcattcgttctttctaaaaattcatgaatttcttgcggcgaatcatcttttggtgatccaccaagtttttttgctaatagcaaggttaaaatggaaggcattaacgaatgaatataagggtccaggaaaatagaagtattgcttagtaaagagtaaatcatttccaaaattgttgttagcaattgtaaatcggaaagattttgtgtgatttgttcggcaataaattgaataaaatatggaaccagttggtgcaggccactatcagttcgtagtgaagtcaaagctgcttgtttcatatgctgtgcagcttcatcagcttgactcttcgctgtcaaggttgaaatgaccttattgaaataaatctgtaattctttggataaaacgtgtttcactaaaggtttgacttcagtattctgtcctggtttaacattagacaggtgttgagaggcgcctgtatccgtcacagaagcacttgctgtcgtcgacgttacaggtgtttggaggctgttatcattcaaagcagtgacaatagcacctctaataaatggtggttgggatacccttatatcattcaaatttggattttggattatggcaggttgaaccccttcaactgctagccaatgtgtagtaaaagttggtagacgaggcacttgcggtaatggctcatttattaatctatcaaaatctacttcttcctcatccaggtagtaaaccgactgtcctccacttgtgttaaccttactaaatgatacagctttattaacttcagagccatcataatatccatataaaggttccacattcagaacacgcagggccttcgatacatcgtctgtagttaaaacatctcttttagagtgtcttttaaacttgactgcctgttcaataatctctagaatacggtattcaacgtccatagcaagtgctttcaacacgtcatcgttgatattttccaacccaagcgactcagcgacatctttaacagtatcttgtggagaccaaattgtgtaagattgctgctgtgtagacattttaacaggctatcaactacactgaggcgtcctttgcttcctttttaaagccaatctattgttttcgctcatgaactacttttgctgctacttgaatcggtgtttgttattgatggtttccgggtatttttttggtaataaaataaagctgaaaaattttgtaaagcgatgcccaatctcgaagcctcacttcaatgaacataatacagagaaaatttaaccataaataggcccagcttcgatcgtaaaatgaggttactagtcagctgtgtggatagtggatccataaaggaagttttgtgtaacatcgggactgacacttccgtacaatcagcactgcagccttttcatgtggcacctcatctagccgaaggattgaaagcttacgttgacaggatgtgggtgatatccgaagatgaagccatcttagcaaggaattcaggggtcgtcgaacttgtaaagatttcgaaacaccttaaagaaaatgaagctctccaggtcgatcccaaaggagaaagcaaaaatgaaaagagcctttccgatgatctacccaaatttgacatatccgagtttgagataaccagctcagtttcagacctttttgatgatgccaaattggaatcactttcaagtaaatctgttaaaagaaccaagttggtggatggttttgtcacattatgtcccataaaaaaggattcgtcgaataacacattcgtagctgctaccaaatcgggattattacatattataaaaaaaggagaagataaaaagttaataaaactagcatcccttggactgaaagcaccagtagaatttcttcagttatatgatctagaagataccgatactgataaatatatatttgcatacggaggggaggagaatttaataaaattagtggaaatagattcgagtttccaatctttaaagcaaatttgggaagccaagaatgttaaaaacgacaggttggatatgagagtcccagtatggcccatggccctaagatttttggagccctcccctggtaaaactgaaaagggtaagctgaactaccagtttgcagccataacccgttggtcccacctcaccaaatacagcacacaacatggcagaaaaccgttcgctcagatagatttattacctaaccgtgaaccattatctcagatggaagtttttgatgccaagggagaaaatgttgtctcttcgttggggaattttcaatctgaaacctttaatgaactgaatgtgattactactgactacaaaaagaatgtttttaaattcgatggtaatggaagaatgttgggcaaggtgggtagagatgatatcactggttcgtcaacctatattcatgtacatgacggcaaatatcttttacaaggtggtttagataggtatgttcggatcttcgatataaaaactaacaaaatgctggtgaaggtttatgttgggtcccgtataaattttattgttatgctggatgacgttgaaatcgagatgccactaagtccaagtgcgaaagctgccaaagggaagcaaaaaaggaaggttacagaacttgaagaagacgcagatgagctttggaataaattggagggaaaggtagctgcttctaaagccagtaagaaaagcaaaatttaatagtaaaggacgctaattgaaggcaaagttttactagtcggcgggaaaaattattaaaaaaagcacttcctgaacgcgacgctgaataacttataatacgttacataattgtataccgtctagtaaacttacatacgcttgtctatcttgtatgctgatgcattttatcaaatagcgttatttcccgcacgagccaattttttatcgtgccccttcttacggttatggttagctctagcccctttccttttttcattcttagcatgctgtcttttcttctgttcagtagattgaggttcatgtttcttaatattttcagattttttttgtttggcttgttctttgacgacatttccatcattttggctatcacgattatgaacataagacgttttccctgttttgctatttcctttgaacataaacttcttttctaaaagtcttgctcgggtaggagatctttctaacatccgacaccaaccttcgattttttcatccgaccatgaagtcatttctttcatagttttcctgacttttgtacctctttttgatctctcaaataatttcggatcctctttcaatagattccacaagtaagcttcaacaatatgatagttatgatcttgtcgcacttcattagaatcatcttttgtatcatagctttcttcgtcttcttgaagtccaattcttttcgaaggatcggaccggttcacatcggcttcatcataagtgtcatccctttcatcttcatcagcctcgtataaaagtttcaatgctcttgtcaaagttttatttcttaattcatccggaacaccctccgagataatctttttgtctagctctttattttttgagctatctcctctatccaatatactcagttcttcagtaaaggatgcattatcaccatctgacaccggctctacttcttcctccgcaggttctctggagaatgcttcgataatggtaggatcctcaaatattttattcgttactaattcaatgttattatcataggcaagcaacgtttgagataattgatatttagaaaactgggggaacaattccatcaacgcggacagttgttcttcattaacttcagtacctgatgatgttggatagctcatatggtctccttcgtccattgacaacccccctaaattcagaaatagtaacttgctcttcaaatcaggaagccttttgtggactccttcatttatgagcattgttcctaaaagaggatataacgccaaagtttcaaaattgcttatgcctaattctttagttatttttagtaaacgatcagcagaaacagaaaataaactgataatgatcaattctctagcctctttatgaccccggccctgtccctttgcccataatgcctctaaaatttcaatccaatttgccgtaaagaagttctccgcaaacttatttggctgcatggatttggcagacagcagatcttcaacgcaccttaaatctattcttttaaattttccagattctattaactgcttcaaatgctgttgaacttggtacgatttgtccaattgtacacgttgcgtgttgatccgtggtttcaatgagccatcgatcaaaccacgaatagaatctggattacgtctaacatatactttgatcaaattccacagggagtcaccaaaaatctgaagatgtaataacccgcatttcttgatcaatgaaaatatccagccttttagtaaatataactgttcagacacatcatggttgataccgagacttaataactttccttcctcatcagcaatttcatgcaagtaagttctcaaaaataaacgaagatgatcaagtgtagattcatctaataattcaacgttagcaccttgcatcaaatactcaaaatacgttacataggtttctattagatgcagccatactacggggtccttttcaattaattgagctctgagtttaaacggtggaaatttgacaatgggcagagaaatatctgcattacccccatttatttcaataacgcggttgtaccttgataacattattcttagtgattctatcctataaaaatttccaagattcaatagttaactcgaatgtctctcatttatgagaactagtgttttatattttcattttttctatggccgcgcaaaatccattggcagatattcaggtatataaacgttacaaagccaagaggagaatggaaggccaacaaaaaaattcttgtacaattgcatatattgattcattacaatattactgccgtcgttctctcagtcataaatcatgttttccctttccctctcagcatgctttttctcggcctcttccattaagcgagtcttatgagacttggcacgctcttgagctagctttttgcctaactcgcccttattgtacttttcattcgtctcttgaaatctcttctcagcagctaaccttgcggcctcctttgggctaactttatttttgctcggatcacttgtatcagttaatttgctgccttctttcctttgcacaaccgggacagttgtactctttagttgtgtcttcttctttttatctttcttctctttatgtcgaagttcttgctttgacttgactgtatcacgattaattggttttgttcttgctttagttgccaccgtcgtagtttgtgaaggcattggttgggttttacttccgcaaagccccatactatgtacttaaatatttgttgttgtttgctggtgcaaatttcctggatgatgttaatgataattatagaccgcttttatatagtcttatgcctatccttttcatttttatttttctagagggaaaaaatcgctgattacatgagggaaaaaaatatacacatttcttgatcatagaagattcgatcttatatattatacgtttaaatgtttatttacaagcatgcataaattgagatggggagaatgaatgcgctagtactattgctccttagcaataaagctatgtagttgaggaacaggaatgtcctcggcactcaagtcagaataaccgctcagatactcatttaatattgggtatgactctgcgcatccagtggtatacctatatacttgcttggtagcgcgaaagtagggcgtatatctttttaatattttcaagtacagctctattctgtcttctgaattcgaagtagaatcctcatttttcaaattttccaatggcttcggaacttttatgtcgtcttctgtggtcgtagtcgttgctggtgttcctttagcttttgcagaaaagaccttttcatccctctttgattgtgaccatacgacagtggcatccctcaaagcggacagatcagcattggctatatattgttggcccaattcattcagtttcttgaccaactccagccatctatccagaatctcttcattattcgtgttgtctatgcttcccaatgatttcagtagtattctatatgatataatagttcttggaatatggtacaaagtatagtttttatcgataaaatcgattatgctgcgttcgtgccagatagatgctctagttaacataacgttaaaaaatggttcatcaatttttttgaccccactgtaaaacgttatgatttcttgaagcttacggaaaccattgatattgtcattaatatagttttcgaagaatattgtgaaaaaagtgttgtttagtgaggacaaaattccaggattaacagtgttaccataaaattttacagccttttcccatattctataaacatgatcaaaatcgttctgtgctttccatatattctgcaaaaaagagttcactgtagagacttgtaaaataatcttgtatggcatttcatcgttgataattttgtcaaagaaactttctgccaacgttaaattcttggaatcaccaatgaagcttaagtgcgtttcaattaaataaccgtaattcctcacttcagccttttcacataattggccgaagagggataatgccttttcgtagtcttccgccttgatgaagacttttatcagtccgctgtaaagattgggatggataaattctttggattgaataatttggttatatagctcgttaggctcagtcagagaacgcgtttttgcataaagtaatggcagcataaaaccaaccacttttggttcttggaatgcctgtgaagtagtctcgtcggacaaattctttgacgcttcccaaattcgaatacagtcatcgtcaaatgacagctctttaaatgaagtcaatagatgagtagctccatatccgctgacagacaccttgcctatcaaaatgtcatcagatatatcctttaatgaattacatagaaagttcatcatttccttgtgaaaagattgcgaatcgtagtctggctttctacttaattttaccaattggtctctcgtcgacctcagaccgttatgcagcagatgaatcaaacgtgacacccggtacgcattgaaatcaggcgattctctcaaagaatagtataactccattgctctgcccatggagtcccaaaacatggcgaatgatggatttttattcaattggttgtttcctattcttttgtatgtattttgcaaaggcgtggtagagtactttaaagcagatgatacacactcatcaaacgaaagaagctcgtggcgccatggagaagctggatccacattaaacacattctgttctgttttgcgctgttctcgcccattcttcttgtccaaaacgcccttaggtacatttttatgaaatatcggactggagtggtaagtacggtcgctaagaactacgttggcaagcttacctctcagcattgctatcgaaccggagttaacaacgttgcttacgcttatttccatagtttttaacgatctcaccgcatttcttctaagcatcattgtcccttttgcagtatatggactctccgaatagtgtaagaaaatgacactgaaacctcaccttcttttacttattgcttagaccctcattacaatgccatactgaatacattttttcgaatcttgttcagtcaggaacctcaaccatatatcattacacacgagtagtaacaaaagcattttgaagtaagatttgaaacaaaataatactcagagtagatcgacgtataagagttccttccccagcgtattccgccaccacccatcgcacatacatagaataacaatgtcagccaccagagccaataaagatattttcacactattcgacaagaagggtcaaggcgccattgccaaggattccttgggagattacctgagggcaattggctacaaccccaccaaccagctcgtacaggacatcataaacgcggattcgagcttgagagacgcctctagcttgacgctggaccagattacaggcctaattgaagtcaacgaaaaggaattggatgcaactaccaaggcaaagacagaagacttcgtcaaggcattccaggtcttcgacaaggaaagtacaggcaaggtatccgttggtgacttaaggtacatgctaactggcttgggtgaaaagttaaccgacgctgaagtagacgagctgttgaagggtgttgaagtggacagcaacggagaaattgactacaagaagttcatcgaagatgttttgagacaatgagagtgcggaactgcaaatttagacatttattactatataacagagtcctatcgaaaaaaaaacaaaaaaagcgccattatgcaatgaaaacttgccagcggtttttcatttttcatactggtaattcagagagccaagtctttaatgcatagcaataaatagtcatatatatatatatatatatatatatatgtacatatatatgaacatatatatgaacaaataaatgataatggtatgtgatagtcattattaacgattaagcgtttttcttcagtttctgagggattctaaccgcttggcgattttgcaagagataagaaaatttttcagtcatatggataacctaacacagcgtgcgacgtattttacttcagggcccaattgaataagaaagtataatatagagtttcaagagtcaatgtccgatctcgttaccaagttcgaatcgcttattatttcaaagtatccagtttctttcactaaagaacaatctgctcaagctgcccaatgggaatcggttctaaaatctggtcaaatccaaccacacttagatcaattgaatttggtgttaagagacaacaccttcattgtgtccactttgtacccaacatctaccgacgttcacgtcttcgaagtcgccttaccattgattaaggatttagtggcaagctccaaggatgtcaagtcaacttataccacatacagacatattttgagatggattgattacatgcaaaacttgttggaagtgtcgagcactgacaagttagaaataaatcacgatttggacttacctcatgaagttattgagaagaagaaaaaggcacctgcgggtggcgctgctgatgccgcagccaaggcagacgaagatgttagtaagaaggctaaaaagcaagatcatccaagaggtaagcctgatgaagaaacccttaagaaattgagagaggaggcaaaggccaagaaggcagctaagaaggccgccaacgccaaacaacaacaagagcaacaaaataaggccccagaaaagccaaagccatccgcaatagatttccgtgttggttttattcaaaaagccatcaagcacccagatgccgactccctatatgtctctacaattgatgtcggtgatgaagaaggcccaagaactgtttgttctggtttggtcaagcattttcctttggacgctatgcaagaacgttatgttgttgttgtatgcaacttgaaaccagttaacatgagaggtattaaatccactgctatggtattgtgtggttctaacgacgacaaagttgaatttgtcgagccaccaaaggactctaaggccggtgacaaggtgttctttgaaggtttcggtgacgaagctccaatgaagcaattgaatccaaaaaagaagatctgggaacacttacaacctcattttactacaaatgacgggttggaagttatcttcaaagacgaagaagaaaaggaccatcctgtaagaaagttgaccaacgctaagggcgaatcattcaaggttgctagtattgctaatgctcaagtccgttaaaaagatataatatcacgaatttgttactaatttaacatgcgtaaatacttatttcacatatataattcaaagatttataagtaaatgtctttgtgctaataacacgccgtcccgatacgcctcaatggttagcccttatttcattttagccgctcctcttggtctccggaaccttcttccagataaaggcgcttattgagcatgctatgatagcaaaaatgatgaaaacataacctgacaaaacatcatgaataatagggaaagtatatgcaatgataaaagttcctacccaattgcaaatggtaccatatctttgcgcaaggaccatatcctgtggttttgatacttctctcattattataaatggcaacggatttaaccccatcgtgaaaacgcccatatatataaatgaaaacacaatcaaaaggttcattttattatggttcattgctattcccataatgaaggcggtaacagaaactaagacggtggacgtcatcagaagcggtttacgtggcaaactatgaattagcagagaaactagtatggtgactaatacattcaccatactaatgaaaaagtttatcctaattgcgtgctgaggatacagttgactaattatcttggtaccatatagtacaatggagtttataccgcagaattgttggccaaataacaatacagtgataacatggcgagacttgacatttgttctgtccctcaagtatttccataatgaattagaaccgctaatagagttcgtggtggttggttcaatcaacggatccccagattctatttgcagttgccaatcctgtatctcttgtgcggcttcatcaaaagtcacgccacgtagcttacatagagataacttagcatcggtgactcttccatgtgctaacaaccattttggagattcatcgactataaaccacatgaaaaaattcaataccgcgataaggaagctaccaaacaaaatccacctccaacggtatgaatcagtcagtgggagggctattccttgtgtcaacaagacccctaacctgatacagatttgtgtcatcgaacccagtaaaccttcccaaccgcttggagcaacttccttaatgaaaaggggtataatcacgatcaaagagccacacgaaatacccactagaattctaccaatgattaagcccctataactattcgaattgaagattatcagcgaaccgacgatattcaatgtgcagttaattaaacttgagaacttccttccataaatattggccagactggtggcaaaataagagcccaaaatgcctccaatgcaaaaaacggaggtcacgattccaatctgttcatcattcaatggtatacattgcttatatcctctttttcccagccatgttctgtcatagggatagccctccatgggaatgtcaaattctgagcacgaaagcacctgctgaggtgcatttaattccgacaagtggtaaccaaattgtattgaaccgattgaggctactataattgcataacataacgcctttgtaattttatgcttgttttgccttggcatgctaacattggatagcaacgatgcactagatagaatcctattcatactatgctacgtacctgtttaactcttctcattttatccgttttctttcttcaccgttcctcttaagttctttatttttttcataacagaatgatcacccctttcactttgccgccaatataatattaacacacaagaaataagtatgaggtagtttgctctcgaaaaaaccaagtaatagttcaaaaaatgaaaaaaagaaaacaaataccaaattatgccaccgttaccttacgtttcatggttaatcatcgtttactgccgcctatgagcgtaagctaatgttataaagaaacaagctataatattgttaaatatagttgatcaacagcattgtaatgattacaagagacgaggtggaatgaaccttatgaaatgcgttttatatataaactgtaataagagctaagttgaattgaaatctacgatacttgatgttgacattatagcactagttcccaggaaaccctttcgaaaaacacagcaaaaacaagagtactgtaaccaatgtaacatctgtacaccagggacccacacattaccaaaatcaaaattatttttctaatgcctgttatttttcctatttttcctctggcgcgtgaatagcccgcagagacgcaaacaattttcctcgcagtttttcgcttgtttaatgcgtattttcccagataggttcaaacctttcatctgtatcccgtatatttaagatggcgtttgctttctccgttgatttttttccttcttagtgatttttttgcattaaatcccagaacaatcatccaactaatcaagaatgccttccagattcactaagactagaaagcacagaggtcacgtctcaggtatgtagttccatttggaagagggaatgaaagaaccaagacggtgactttttttttagtgttgtgcaaccaatatgtcgtgtgtatatcatggtacaggagaatgtcaatcagctaagtgtactcaacatatttctttgtgttttgattgcgaactttgtattaccatctcactgttgagacggcttatttgaggtaatagctcgagtaaatgtactcttccatcgcaaactgagcaaaaagaaagtgtgcatagcctttgtcatacttctcctttattataccatgatattcagaacagtcatactgtctactcattttacggctataaaaggtaactttcatttagattatggaaagcactaattatcgctgtatcaaatggttgtagagagcgcaattatgaaaaagagttaccacgtttcttttgtttcgataaaatgtccagttgaaaacctgttttactaacgatttaaaaattgtatttcattacaatattttttttgtacagccggtaaaggtcgtatcggtaagcacagaaagcaccccggtggtagaggtatggccggtggtcaacatcaccacagaattaacatggataaataccatccaggttatttcggtaaggttggtatgagatacttccacaagcaacaagctcatttctggaagccagtcttgaacttggacaaattgtggacattgatcccagaagacaagagagaccaatacttgaaatctgcttctaaggaaactgctccagttattgacactttggcagccggttacggtaagatcttgggtaagggtagaattccaaatgttccagttatcgtcaaagctagattcgtctccaagttggctgaagaaaaaatcagagctgctggtggtgttgttgaattgatcgcttaagcgcatcaacaaaaactctatgtattttccaataaattatatatcttcagtttaatctaattcaacatctacttctgtattatttctatcacccattttcaccgttttttcgtcttgtctattttgaagttaccagtggcagatcccaacgcttttatcgcttttttaaaagattttcaaaatccatatataaacatagggtccaaaaagaaaacaaataacaaaacaagaaaacctattcgaggtaaagaccaggaaaaacaaaatgactgcagttaacatctggaagccagaagataatatacctagggagattttggcaattctttcgaaacctcacccaaattatcagttagcgtttttgaatattatacaacttttgaaaacgcaaagaagaactggttgggttgaccatggtattgacccatgcgaaagtatatctgaccatatgtacagaatgggtttaactaccatgctgattacggacaagaatgttgatcgtaacaaatgtatcagaatcgcacttgttcacgattttgcggagtcattagttggtgatattacacctaatgacccaatgacaaaggaagagaaacatcgcagagaatttgaaactgtcaagtatctctgtgaaagcataataaggccctgcagtgaaagcgcatctagggaaattcttgatgactggttagcatacgaaaagcagacctgtttggaaggaagatatgtcaaagatattgataagtatgaaatgttggttcaatgttttgagtacgaacaaaagtataatggcaagaaggatttgaaacaatttttgggagccatcaatgatataaaaactgatgaagttaaaaaatggacacaatctttactggaagatcgacaagcctttttcgacagtttgaaggagtaataatgtggccttttgaaagaaaagttagtgcttttttttcttttctcaaaccttcacctggtggtgcgtatcatttataataacatcttgatgcttttcaacgagatagtgcccattttattttgcatgtattatacttccagcacccggtgtgcattatatgtaactttagaaataatcttttgtatattattcgcgattgaatgtgcgtgctgcattatcaaccaagttttaatatatctgtttctcttatttattgttagttaagtcttcggcaaaacgatggaaaaaatcatgaactgaatagagacaagtaaaccaaattataaacaaggtttcccttctgaagagatactaaggaagaagaagaacgacccaataatatttctgaatatgcaaccatttgatagtgggcatgatgatttagttcatgatgtcgtttatgacttttacggaagacatgtggcaacatgctcttctgatcaacatattaaagtttttaaattagacaaggacacgagtaattgggaactcagtgactcatggagagctcacgacagtagtatcgtggccattgattgggccagtccagaatatgggcgcatcattgcttcagcctcttacgataagacggtaaaattatgggaagaagatcccgaccaagaagaatgctctggccgtcgttggaacaagctgtgtaccctgaatgattccaaaggatcactttatagtgtaaaatttgcgccagcgcatttgggcttaaaattagcttgtttgggtaacgatggaatcctcagactttatgatgccttagaaccttctgacctaaggtcatggacactgacttctgagatgaaagtgctatctataccaccagcaaatcatttacagtctgatttttgtctctcttggtgtccttcgagattttctcctgaaaagctcgcagtctctgcattggaacaagcgattatataccaaaggggtaaagacggtaaacttcacgttgcagcaaaacttcccggtcataaaagtttaataagaagtatcagctgggctccttccattggtagatggtatcaactcattgcaacaggttgcaaagatggtagaattagaattttcaaaatcacagaaaaactaagtcccctggcctcagaggagtctttaactaactcaaatatgtttgataatagtgctgatgttgacatggatgcacagggcagatcagactcaaataccgaagagaaagctgagctacaatcaaacttgcaagttgaacttctaagcgagcatgatgaccataatggcgaagtttggtccgtgtcttggaatttaacgggtacaatcttaagcagtgctggggatgatgggaaggtacgtttatggaaagccacttattcaaatgaatttaagtgtatgtcagtaattactgcccaacaataaataagaatatatgtatacataacattatatattggtactttatacgtgtgcattattctgtataatacgaggcaacagatgaatcaagaaagatgatgcttttaaaaagctcttacaaatataatgatattacatcaaatgatattattattcttgatattgggtattctttcgaattatatcaagcttcccttccctcgccttttcgcctggaaatttttcaatgccgagattaaaaaatttgtcaatgaaaatgcattctactacttaataaagaggtgatgagcttataagccaacttcttttaaacacaaaactaaatctgatattgaggacccccaccaactatgccaccaaaagaagctcccaagaaatggaaggcgccaaaagggccaaaacctacccaccgtaaaaataaaaataagcttgaattaggcagagctattaaatatgcacgtcaaaaagaaaatgccatcgagtatttacctgatggtgaaatgaggttcactaccgataagcatgaggccaactgggttaaattaagatctgtaactcaagaatcagctttagatgaattcttgagtacagctgcactggcagacaaagatttcacggccgatagacattcaaatgttaaaattattagaatggatagcggtaatgattctgcgacatctcaagggttttctatgactaatgagcagcgtggaaatcttaatgcgaagcaaagagcgcttgctaaggatttgattgttccaaggaggcctgaatggaacgagggcatgtccaagtttcagcttgataggcaagaaaaggaagcgtttttagaatggagaagaaaattggcacatttacaagaaagcaatgaagacttgttgttaacaccgtttgaaagaaatatcgaagtttggaaacagttatggagagttgttgaaagatcagatttagttgttcaaattgtagatgcgaggaatccgttgctgtttagatctgtcgatttagaaagatatgtaaaagagtcagatgacagaaaagcaaacttactgctagttaataaagcagatttattgaccaaaaagcaacgtatcgcttgggcaaagtactttatctccaagaatatttcgttcacgttttactctgcattgagagctaatcaattattggagaaacaaaaggaaatgggggaagattatagagaacaagatttcgaggaagctgataaagaagggttcgatgctgatgaaaaagttatggaaaaagttaaaattctgtccattgaccaactggaagaattgtttttatcaaaagctccaaacgagcctttattgccacctctgcccggtcaacctccactgattaatattggtttggttggttatccaaatgtaggtaaatcctccactattaattcgctcgtgggtgccaagaaagtttctgtttcatccacgcctggtaaaacaaaacacttccaaactattaagttatctgattctgtcatgctttgtgactgtcccggtcttgtcttcccaaactttgcatataacaagggtgagctcgtgtgtaatggtgttttacctattgatcaattacgtgattatattggtccagcaggtttagtagcagaaagaataccaaagtattacattgaagcgatttatggtatccatattcaaaccaaatcaagggatgaaggtgggaatggggatataccaactgctcaagaattgttagtcgcatacgccagagctcgtggttatatgactcaaggttacggttctgctgatgaaccaagagcaagtcgttatatattgaaagattacgtcaatgggaaattactgtatgtcaaccctccgccccatctagaggatgatacaccttacactagagaagagtgtgaagaatttaacaaagatttatatgtgttcgacagattaccggacaccagaaaggagcaagtgcaaaatgctgctaaggctaaaggcattgatatcgtggatttagctcgtgatttgaatcagctaacgttttcagctcacactggtggtgacacacaaaaagaagccaaatctgttacgcacggtggtaaacaagctgcattgtacaatgccgctgaggacttggatagagacttcttcaagatgaacaacgtcgaaggtagattaagtacaccattccacaaagttcaaaatagttcagctggtaagagacataacaaaaaaaacaaaagtaaaaatgcgaaaagcaaagtttttagcattgaaaataattagcggtaactaacatatatcttctcaaaaaaactgtgtactattatcttttcatctcgccaattaatgacagcgttatttgagaatagacctaagataataaaactatgttcgttacccggacaaattttcttggaagaatttttgagtcctagagatattataaaacggccctctattaatttgctctttctttcctcagtttaattcttctttcgaataaaaaataaaaatatcatggctcttcaacacatttcaacatgttcaagtaatttgtgttagtggatgaccatttaggggctgctggcctggttaccgggagtttttcttggatccaagctagcttttccgtctgattatccttaagcttcacaaattacaatttttcccacgcattaagaaataagctcaagatgcctaaaataagttctatcccgccttttttcgctaacaatgactgagtattcccacagtctatagtttgatagtagatgggcggaaatttttctcatatatttactttttataggagagtatatttacgtacgtatagtgattgcatgtagttgctccctatatcttgtcatatgagcgtgatactgaccgatacctgttacagatgtcggtctggatttgttcgtttttcttccctaaagtaggtcagtatatataaaatatggccggaggaaagcttcaccactttatcaccactaaatttataaagtagaatacaatttcaacatacacagagaataaaaaaaggttgacaggacacataatagcaaggcaagatggctgaaacttccaacgacccctttctgtcctacgttttgagtagcaaacaattaactaatttgaatcgtctacgaaggaaagcagttacaaaacaactgggatcaagtgacgacaataaggtctcagaggagtttttgaggtatcaacatacttatcaaagagaagcatttgaatatctgcaaacaaaacatgacgcccacaaaataatggagtcacagtacgaacagtaccaaagcagttcaaaaacaagaagatatagtatcgatttagattctgtagatgcagttgacacggaatcgcaaacagaatacccaaatgaggagtttattgatagaaacgaagatagcgaagctgttatggagttgagaaagagattgttggggaagggacagaataagggtttaggatatgaaactacgaaatcagtcgataggcaaattgaggaccaggacacgttgcaacaggatttgattcaggatatgagcaaacttgtgggcagtttgaagcaaggagctgtggcatttcaatcagcacttgatgaagataagcaagttcttggagctgcagagataggtattcaagttgcttctcaaggtttaatggatgttagcggtaaattaaggaaatatgacaagagtaaattgagttacttgttttatattactgttttcatttttatgattctcggactggtgtttacatttatcataattcaattattcccggccctataatgtaattataacgatggaatgatgttttttggaagaaaaattcaactgtttattaatatttacggcattttttcatgtagttgagattattcctattgaaaaaagcaaattgtgagaaaaaagtatacaataaaatttgtataggctgcagaattctcctttccgtatagttgcctacttcccgtctcaaactgaatcctgctatctgattgctttctgtgttggtgcggtgaatctttttatacatataatatttgaaaaagaataaacatttgagaaaacaaaagtagctaaacaaaacgacaaaatcataacatttcctgatctgactgaaagctaatagaacagcagtgttcgatgagggtaaaataaggaggggtcttcggttacgttatactagtaagttgattttgattttaagtcatattattgaacgcattatgatgatactcataatggactaaatttttctcatgtataaggtccatagtagccaagtgcattccattacaatgttattgatattatctgtgctctcaaattcggctgaagaaaactactacaaacacaacacatcaaataatgtaacacagccttgcttattgccggtgtaagggtcgactatcttcgatctactcatattcatattatcaatttattatcatatatggtataagaaaatgacatgaacattgagaaacaaccaatagattaattggaagctgaaatgcaaggattaataacttgataaatggaagttaaaagatagtattaatgatgactaaatatggattctgttatccttgtataagagaagtataaaacaaacaccaattggtttattattctcttttcttcaattataatcagtacaataatggctccagcagctgtcacatattttaatgatgatttgcgcatatataacagagataggtttaaataatttaataattgttgggatttcacaactattgaaggctataatattatgtataaagaatataccaggaagtcaactcccagaccttgaaatcctcaaaatgaagacgatagttttacataataatattactttttcttctttccttctatatttctccttcacattcatattacgctgacaatctttgcatttcagcttccaccaagcctgatcaccgtttaccaatatttgtgtcattttcttatacctcaggtaataataaactagcaacctgaataatatcaaatagacgatatgttaaagtttcattctaacaattaccacccattccaaaatatctattgttagagaggcgttaatagaacaacacaacacaaaaatactgaaggtcaaagtttgttgtattacgggctcgagtaataccggagtgtcttgacaatcctaatataaacggtcttagggaagtaaccagttgtcaaaacagtttatcagattaattcacggaatgttacttatcttatatattatataaaatatgaatcatattaagtggtggaagcgcggaatctcggatctaaactaattgttcaggcatttatacttttggtagttcagctagggaaggacgggttttatctcatgttgttcgttttgttataaggttgtttcatatgtgttttatgaacgtttaggatgacgtattgtcatactgacatatctcattttgagatacaacaaagttcataaagaaattagccatcttagtatagtggttagtacacatcgttgtggccgatgaaaccctggttcgattctaggagatggcattttttccgaaatttcgccttctcgcacaactttccaaacccgaccaagagaaggaagaaatcattttttttgttgcgagttgtcatagaacgaggtcgagaaacagaagaggaattgaaaatgaattgtaaaagcgttcgttctatgcctctaataagagagtacgtcttgcttgatgtgaacccaaatgcccacaaaacagtacgatttgcagttatgtaaatttgtggtttgtctcctggcaaaaagaatgcattcgtactgcacataattgaaataaggatgtagttcaacttctatgaatgctcggcgatacgatatgtagaggggacaaaaatatgtaggtatcctatggtaaataaatcggtctgttttaaaacctgttttagtgcagcttctttccacgaaagaaatagtgtaagttagaggtacttctcttttacctaaaggaggtgtagttatgataaaaagcgaagctaactaagacagctaagctctttatgttgatagttaaaagttaacaggttgtattaatgaagaatgaatatggatctttttgtacttatataacagaggtataaaccacatgccgattgtttcattattatatatggctaatataatggtgattccggcagcttcatacatttaatgtgacgactcatattgctcttatatgtgactttcagatctcattcaattaatagactcttaactcaaattcagtactttctgacatgctcatttacatttccttttgtaatagtgcttccatacttcatcgtataggatttaaacatttagatcgttaccatagtaactcatgttactattaaataccgctcgtttcaacacattatataatactttggcattgatacgccacataatattctaatttctcttcaacacataagacaaacagggcaaatcaagcaacaggaaggtatttgcttcttaatggcaaaacaggttcagttccactaaataaaaaggggaaatttacgtgtcatttattatgggttcagaaattatgtgttaagtaaaacacctatagcactggggcaaattccggcatcaatttcaacgccaccaaaattgtgtgcgataataattgtgaccccatcatggaaatgagccttcagccagagacggaaaaactcttgaaaggaatactgatggatttataggttcggaaaataataataataaaaagccgtgttggacattatccctcccgttgctcgcggtaaattcttaaggccatatttcaggtaggaaccatcgtcaacaattgctacaacgttttgtagtccccaagattgaaatacaatagcagttgaaagagaactacctaagataattcaatgaggcaattactgattattcctgacagagtgtaaaatatttgcaagtaagagaatcggaacagaaaatttagatattatgagagtcttccctcggcagtaacgatataaagccaatctgtattccagtgtcctgccattctggttctttaaaaactcacttccaagatagtataatccgagactctaaagaaaaggacacttgcttttaatggacagaggaacaccgcatactctaaagtagagagcaccgatatcaagagttacatatatatatatatatatattgtttgcttccgacagagatagctatctagcaattcccttctttttcaatcgttgggcggctaaaagtagcagggtttcgcgaggacctctcgaaggacaaacaatattcattacccgcacaaataaaatttcaaaaaaacaaaaaagcacgggagaggcaaggcaggatgaataaaatcaccgatctcgagaatattaaaagtcatcaagacatcctctttaagtcaaatcctggatccagaaacttaaaaagttgtcatataaaagtttaaaatggtcaaaagaacagtcgccaccaatggagacgcgtctggcgctcatagagcaaagaaaatgtctaaaactcatgcttctcatatcataaacgctcaagaagactacaagcatatgtacttaagtgtccaaccattggatatattttgctggggtactggttctatgtgtgagcttgggttgggtccactagccaaaaataaggaagttaaaagaccaaggttaaacccatttttacctcgcgatgaggccaagatcatttcttttgcagtcggtggtatgcacaccttagcccttgatgaagaaagcaatgtatggtcctggggttgcaatgacgtgggtgcgttgggcagagatacttccaacgccaaggaacaactcaaggacatggacgccgatgactcaagtgatgacgaagatggtgatttgaacgaattggaatctacgcccgctaaaatcccaagagagtcatttcctcccttagcggagggacacaaggtcgtgcaattggcagctacagacaatatgagttgcgccctgttcagcaatggcgaggtatacgcatggggtactttccgttgcaatgaaggtatcctagggttttaccaagataaaattaaaattcaaaaaactccatggaaagtgcctacattctctaagtacaatattgtccaattagctcccggtaaggatcacatacttttcttagatgaagagggtatggtgttcgcctggggtaacggtcagcaaaaccaattaggaagaaaagttatggaaaggttccgtttaaagactttggatcccagaccatttgggttaagacatgtaaaatacatcgcatctggcgaaaaccattgctttgctttaacaaaagacaacaagttagtaagctgggggttgaatcagtttggtcaatgtggtgtttcagaggatgtggaagacggtgcgcttgttacaaagccaaaaagactagcgctacctgataacgttgttatcagaagcattgctgctggtgaacatcactcattgatcctatcccaagatggcgatttgtattcgtgtggtagactagacatgtttgaagttggtatcccaaaagacaatttacccgaatatacttacaaagatgttcatggaaaagcacgtgccgtgccacttccaactaagttgaataatgttccgaagttcaaaagcgttgcggcggggtctcaccattcagtcgcggtagctcaaaatggcattgcctattcttggggttttggtgaaacctacgccgttggattaggcccttttgaggacgacactgaagttccaaccagaatcaagaatactgctacacaggatcataacatcattttagtcgggtgtggaggccaattttccgtgtctggtggtgttaagctgtctgatgaggacgcagaaaagagagcggatgaaatggatgattaaggtagtagtacaaagataaataaaagaaaatcgacataatgcacctcagtataaattgtaaaatataacataaatcaaagaaaaacgagaaaacgatatgattatccgataccgacaaattctcatgtttattttttttttttttttttttttttttttttttttttttaatttttcttgggcctttacattgagtacaggggcataagtgcgaggagttaccagacgacaactagcaggcggatgaaatcaacactgagtaagtattatgtaatccatccgctcgtccagcccttcaggttcttcctcttctgcacgtttctctagtaatgaactttctaaggaatttaatcggattttttgagaaaaacggagaaaaattaaaaatgtgccaagacaccagcaacaggcaaagcaaaggataaacttccggtgaacatgttagcacggaaaaattcattgctctctctaaccgcgacaaattacctatcgtattttaactttcttcaacagcattatggaaaatgcataccggagattgctcatacagaccataaaaacaacagaaagtcttgtgaggaagataagcaagcacggtaggtaaaccagatatgcacataaattaccgctgactctcccctaaaagaactatattgatggtctgacatataaggcaccgctgaaaagcatgtacaattttaatgtctttgcatttgcatagtcagtgtggcgtgcattctccacagaatctaactaatcaaatgtatcgtgactgggtgttgcatcattttcgcgaataaaaaatagaacactgtagagtagcgcagcgctttttttttattgaggccctttgcagaaccaaggctgcagtcttttctctgaagattagctttgctaatataaacaaatccgttaagttcttgggaatttctttgaagggggggaggcggaaatgtagtgagttgtttttactgtgatttgctttttctttcgctcatggcttattttcctttccttttcttcccacattcaataatgcagcgtaaatatagaacaagattacttgtttatacgagatatacgggcagtgaataaagtggtactagaactaattatcaaaaagagtaactgtcattcaacatttctggctctagacccaataggacataaacttttagatttttgaaaaatggcttggcgcagcacggtaatactagttggttttttaagcctactttcgccaataaaaaaaactacgaaacagttcttacttaccaatatcccctgccactacactgtactttagtgaacccaacatcacgaataagaaacaataaacaataaacaataaacaagtgttgctttagctcaacttgcccctgagaaataacagcgcaactatcaacaatgaatgcatagcatggagtagagtaaaaaagctttgttttggccccgcctagacaagaggcagctgcgcgaaataagaaattataaactcttgtttttctatactgctctcgctcaacctttttttcccacgcctattatcggttcaagggacagcagatccgctctgcgcactggagcagaaacattcccagttcggttccgactaaaacccgccttcccacgcgaaattctgggccgttcaaggcaacttattagtaagaagagcaaggggaaggtacattaaagcaagagaaccgtgcatgaatttatagacatttttcatgggaggtagggaattttcagactttaagttacaccccataggggcaaacatacagcagtggttgttatctttcattcgcgccaggaaaagccgctacccacactaagtgacgtgtaattgccgttcccttgttttgaagcacactgaaagctgaagtgatcataagaaaagaaaaaaataaatgctgagaagggtttgcaaaaaaagaaaggttcctagtatatatatggaaggcttcgttagcttaaactttctacagtcatgcatacagcaatttttttagagcattacttcttgagtggcaaaagcatttcttttttttttcagtataggaagtaatcactgtagaaataagtcaacaataattgcatagaaaaaaatgggtactagcatagtaaatctaaaccaaaagattgaactgcccccaatccaggtcttattcgagtcacttaaccgagaaaatgaaacaaaaccccacttcgaggaacgcaggttatatcaacctaatccttcatttgttcctagaacaaatatagcagttggtagcccagttaacccggttccagtatcatcccctgtttttttcattggtccttctccacagagaagcattcagaatcacaacgctattatgactcaaaacatacgtcagtatccagttatatataataataaccgagaagttatatctacgggtgagagaaattacataataactgtaggggggcctccggtaacttcttcgcagcccgagtatgagcatatctcaactcccaatttctatcaagagcagagactggcacaacctcatccggtaaatgagagtatgatgataggtggttatacaaatcctcagcctattagcatttcccgaggtaaaatgctatccggcaacataagtacgaactcggtccgcggatctaataatggatattccgcaaaagaaaaaaaacataaggcacatggtaagaggtccaatttaccaaaggccaccgtttcaattctaaacaaatggttacatgagcacgtaaacaacccttacccaaccgtgcaggaaaaaagagaactgctcgcgaaaactggtctaactaaacttcaaatttccaattggttcattaatgctaggagaagaaaaatattttctggccagaatgacgcaaataatttcagaagaaaattcagttcttctacaaatttagctaagttctgattttacttttttcggaattacctaaaatgggtttacggcatagaagatagatagattaagaggtaggttgacttttcctttgaaatttgtaattttaataaaaattccaaaaaaaaaaaattacaaagtaaaaagacaaactttggtgagaatcttcgattaacaaaattactccttaatattcttaaattggaaaatgatcatggttatcagtgtattttcttttaccgtgtatatcaagttttataccccgtatagcttcaatatacgcacttttctcagatctttttctgccgtcattcctttcttccttttctttcaactagaaaaagaaacgaaatcagaccatatatctagtcgccaagcatttttcccttcttggataggaggagcaaaagaaatactaacagttattaaaatgcaccatgccctctgtacatcataaacccacttacaggcttttttttcattctcgatcagaagagaaaaaaagaaaaatataactcggcaggctgtacaaccttattgttctgcgtagtttacctggtacataaacttcaatcaggtgattttttttttgatgcaacagattattttgtaggtgtatttgttcattatgtttgtatctctgtaggctcatggataatagaaattcttctcctggtacgtattggagtataccataggaatcaaatgctgcccgtcccaggatacttttttggagatatgacagtctgaaaggtgcagaataaggcaagtttctggcaaacaaaaagtgataacagtctaagtgtcttgaaaattgttgttactcttgccattgcgtcagaagaaaggtgagttttacttctatcctatagcgcaagaaggtactcaatagattacagttcttgttgcaagttggagtatcccattaattcaggccattcgccacgttttaaaacgaagttattaaaaagaatataattttggaattcgaaacttaataaatacatgatgctaggtacacagaagacatcattatttatccccctgaattatgagtccacacaagagaatcaacaactctacataataccataattattttgcctttcactcttcagaaagtcgttctttgattctgttgtatcatctgtccttttgtttgggcgtccactgaatttaatggcagcttagctttaacttcatcgaatggtttaatacttcacatcatcttctgaaaatcgcattaatggattatactgttatttaattagcagctgaaatttttgcttcaaaaagagtaacagttgcaagcaattctctcaaaagctaagaagcctttgagccttggaaagcaatgttcatctaaaaacacaagaaaaccctcaaaaagagttattgtgtgcaataacactaaatggaccacagatacatttttgaaaatgatacaatccgtttttgcttataagtacactgaaataaaacctacctgagctggcggcgctacaaacactcaatgtttctaacatatggaacaaagagaagacagcaaattaccttgctataactgtcaagacgttttggtaatacatgctacttgaaaaccctcaagagtcgctacaaacttgcctttccttaataaataaaggcaagcgttatcttcgttttcaatgaagcgtcatatacatgatactattggaataagaattagctatcatctatcgaatagtgttcataccattgacatattgttgtcggaatggaactctaaaatatcatctgtttatcggcattcgtgttagtagtatattatcacatgcggtgtaagaagatgacataaaaattgagaaacagtcatcaaatataatggaagctgaaatgcaaggattggtaatgtaataggataatgaaacataatgaacggaaggagaaataatcgtaatattattatgtagaaataccgattccattttgaggatttccatatcctcgagaagaacttgtagtaacataatattatagtctttatcaacaacgcaatctcaacaattatcaagattcacctaacattcaaatattatatatgatgtaaaaatatgatataaggattgcgaaatatatttcagatttaatgaaggtgatatgcaagtattgatcatttagaagaataactagggaatgaaaaaagagctaatactattattatataaaaataccgattccccttttgcggattactctatccatgaggagaataccctagtatattctgcatgattttataaaccaactattacagtctttataaaaatgaagttccaaaaacttctcatattggcctaatttctcgcgaatatgattggttatacggtgtaaaagtttttccatatagtaatttacctttgtaatggaatttttccaacaattattgtccgatatagtgtaacggctatcacatcacgctttcaccgtggagaccggggttcgactccccgtatcggagttttttgtcgtaagttgagaaagttttttccagttaagttattatgacgcatgcacatagaaggatcaccgaacaaagttgcaattattaggcaccgaatgaagaaaatgagaacctaatttcgcttggcaatagtaaaatgttttatctgcatcgaaaaagttatatagatttatgcctcatatataaaatagaattttagaataagataatccttatttattttgcagatctaatagaatccatatattctttagttgaaagtatagaggtgcctcctaaaaccaccctcattctgttattcatcgttccattgaaatcatggactagccttgcctcctcataagttacaccgccaataacaaacaatattacatcctgaggaatatctttgctctgctggtttccgatcactctatggccttgagtatctatttctttgaaacgatccctgaataacgcatttttagagagatctgttagtaatgacgaaatttccggaatatgttgcatatagacgttttcagcggtgttgctcttagaattcattctactattaaatcttcttgctagttcggttaatatatcgtccttgtcatggttactttgagtcattttatcctggcggctaaaaagcgatttaaatttatggaaaaagttgacgtcctctggaggaagttgttgagacagaatctcaactagttgacggattttgtctgagctggtttgattgtttaaagaataaatacatgcaagctttaacttgtaatacttatcaactgcttcattttgtagcaatttaatcaaatcggagaaatcttcttcattggcatcgtgtgctgatagattttgttctatttcactaatttcccatatattttttatcttcaactgtctgtctaattcccccactatagccatatgctttgcaacatttccagataattttctaaactctggatacttctcaataaagtttttaatatcctcaatggaatttatttggctgttggtttgtgtcttgtctttgtatgtagtcacatattgttttactttatcacccaattcaccaaaattcaaatacatggtatccctgaagaaagcatcttgctttgatgataaggtgaccttctccaggtctttatcaattctaggcactttcgataaatcaactatattccgcttaatgcctatatactcattgatcattgattggtaggtccaaggttgaagtaaaggtgttataggatcagtattacgatctaaaattagtaacacaggtgtcgaatccatcacaggaaaatcaaaaaaagttctttcgtttttaccaatctcataggaaacttctttagccaatctttcacaaattttacttgctccttcatacctgatatctggttttatctttaaggataaaagcacagaaactaagctgttggtacattttgttagccccccttcgctccaaaccaatttattacttaaaaattctcttggttgcaaatcaaacgaaaataaatcttggtttaatataaaaaagtcttggaatatttcttccaccttagtaacagcttccaagtcgtcagattcagctagccgttctaattgagatttagagacaatattactaaagaatatttgatactcgccgtaccgaggatttcttaactcacgcagcagatgttgcagtgtttcctctgtgggtttaacgtaaactaagcaccttaaatgcctggacacttcacgttgctcattttctattctttctaccagatatatttcatgcttcaacaactcactttgagtggcacataaggatatcgtaggtgtggtattcttatccaacagcaaaaccttaatcctttggtgttcattgacattggctacgctcaatttcgattgggaagtcacaattttgtttatataaaagtcagccacatcaaaaaggttcatttctttgttctatacagtaaaagatggccttaactcaaaaccaagtcactgtacctcttcactccttaatgttactctgggtacattgcatatgagccaaggcacttctataagtaagttcgaacgttaactaactgtaatgacgttaccctttcctgaaattggcagaaacaaaaatgaacatttctggcaacttttcgccatacagtcagtactcgttacggacgcccgggaaacaagtaggaaacatatgagaggccaaacaagggtaagaccttcttttctggtaatagatattacttcatcgcacaaagaagtctaattctggcgtgtgatgacaaaaaggtttaacaagacctgtttcaaaatgtttgcatatgttgattacagtatatataatagtacacaaacaccggtaacattttataatttttttgaattttttgtatacttttccaaccagtggtgcgctggtggctcttgagattacgtgaaaggcactgcaccatattatccctttgaagtttctggaactttgaaattatgggctcttccttcttcgtacacgctgttcagtactttctcaaagatagctttttctttcaggtggagatattttttgtaaagaatcaaggcagtatgggcatcttcaattgaatcgtgatttccctcttggatattcattcctaacaacacatatgccagataacgcaatgaaagatatctctttccttgtagaaaatatatggcagtgtcgcgaatttggtttcttgggacattaatattaatgtgtttgaagtcattattcaaaccatgaccaacaaatacgcatccgagctgcattaaaagccagacttttcgatatacaacgtttcttctcacaagccttttggtactcttttcagggtccaagtcaccaggaagaatcccactatatcttgtcaaatagtcttctatgtggttcgtgtttaccacataatcatcgacaaatggtactccatacagttctccttcttcgcctctaataatggatattctggccaaagcagttcttttaggtcgaataatacttctgattccttgatgatcgatttcacatagttcactttgtaatgagacaaattcggcatcaatggcaaccaaggttccagatttaggtgcctcatcatgtgttaataacttatattcacgtcttgcagtatctcttattccgtttgcgaaataatcacggaaaagtatgtcatagttgatggaatacgtatcaacagaaaagaaaggttttcgtaattcttccgcatcacaatatatgataatttctggtgttttccaagggtatgtcattttaagcgcctcttcctctgttatctcaacaaccaaataatcattaaacatgagccacttgaagcaattctcttttggattatattttttgacatatgttactagacgcgtctcgttattgttatcagtgattttagccacgtaaccattcaattcgtatttaaatatgtggcttgtgcccttcaattcggacgccgtcgatcttagaactgccttgtttttaatgatgcttccataaaattcactagttaaccagtttttcgacgaccttatattggaaaattcggtatctaatagtgataattctaatgacaacactgaaggtaaattcttgacagtacactcctgggtgatagtttcggttttgccgcaggttgggcaaatactgttcttttgggttacatttttcatggcatattcaatataaggcaaaatattctgtccattgcttttcttgttcaattgtttgattacggttttgttgattcctgatattgataaggagggtagaagtttgacggtagtgtcgtagtgatcacagctacactctgttcgtatttccgtttccaaaccaaagcattgatttagggtgatattatggttgactgtctgcgcttcctctttaataagttgcgagagcaggaatctgttaaatttttgaggcatattgcgtttaatactttcagaagaattaaaatcctcgatactttcccttatgcacagcgattctaaatactcttctaaatgttcttgtggttcaccgttttctaattgtcttttatcagttaaggatttcaatgacgcctgaaaattggaagaactacatatttttccatgtgatctttccatcatgtcaaagaggtagcctagatcagttagcaacgttgtttcaaaattctcgtctttcaaacacccaacaacgaaattaaacatttctggaataaagcgatacaattgtatgatagcatttgtgtagtgattatcaacatctggatccaatcctgaatactcagtgttattaaagggcgtaaaatcaaaattatcagtaccaaatctacctgatgtcagtggaagtctactgtatgcagggggtacttcgtacttgttgattgaggtatatgtctgtatatcgctggtttctaaaccgcttgttatctgtttccttatatctcttagacaaacgtaatctggtatagcatttctcataccgtatttggtgcgatcatatcttaacaaaggaaattcttgtgtgctcaacttctcattttggctcgagatcacagcaaggttactttttaatttgccgctcgatggtaagggtgacttacctgttaattgcggtatggtaccttcacttttaaacactacagggggccatgcagacaaaagtttatcaagatagtacggcatccccacagaactcaatggatatgtttcatcgtcgacagatattgggccgtcagaggtaatgtcattaaaataatcaggatatgctagcatttcaggggtattggtaaacattcccatgttgtttgatgatcttctccatgtatctaggtgattatcagcttctagtatacccaatacgtcaccattgggggacaaacataactttttaatcgactggcaaggatgaacatattgtgttcttaaagttggattggaaaggtcgatgaaatcaaacgaaccagaacttgaggcgacgatcataacagtaggaagcaaaggatgtaattgaacaaaatctgcgcctccagatcccatagttgttcctttagaaaaggaaacaggagggagttgacgcattgttctcaagtcgtaaacattcacaaatgggtcagcgtataagttataaaatcttttggacttccctactgtaaccaaggtgttatcccgtaaatccatagcggatatggatgcagagtgtgcattaaatgatttgatagtacgattcgatgttggatctagcaaatccacagtccctgtttgtcttccgatagacaaaactttattattagagcacattaacttcactttagatgagtaattcaagagggaatctaagcaacctctgttcaagtcaatggacgcaattccccaatttgtgttgtcaccaccacagtagatattgtttttcagtgaatgaggagaatagcacatagtgttcaattcgctaaatgcagcaatatcaatgctagtgaggttcaatttagtaacacctcttctattagcaaagtgtaaggaatcttcactaatagataaaataccatcccgatgactgagaatatccttcacggaatttccacctatgtggcccctatatcttgtataaagttgaaaagttggatcatatgacgaaatgcaaccatagctgtctccactccaaattaagtttgccttctcatcgaagctaatcgctgtaatttccttatccctattatcgaagcgaaagtatggcttcttcaaatgttccgaaagatcaactggattgttgaagaaatgttgccaattattcataatacattcaccattcagaaactcagtatagcaattgtgttctagtaatctcttagggtgtaatgcagttcaaaacaaaaaataagcaaataaaaaaattttcagaatgtaaaaattctagttaaaatgaacgtgtattatatggtaatgatgtgtctcttggagattctatttcttgtgttcctctatgcccacatagtacgttatttcctatatatgctaacgttaaaagcatgtttctttttcgttattctctcattgaaaaaaacaatacgcgaaagagaaggcgccacccgccccgttttaatacaaatagataaacacataacaaaacaaaggctaattagacactacactcagtgattaagtacttagtaaccgtgattacgacgtcccttgtgatatctaagtgggctgacaatgaatgtggatgaaagaagccggattgggggtagagagaaggatgcggggcccgggaaaggcattcttaagcagaaccaaagctcgcaaatgacttcaagctttctagagaaccctggtgttcgtattcctaccaggattataacaaaaaaagaagtattagatggtagtaacacgacatccaggatcaatacttctaatttacagagtatggtaaagagaagagtttcattcgctcccgatgttacgttgcatagttttactttcgtacctgaacaaaacaatgaaattaaggaaccaagacgtagaaaaacttcaaccaacagccctactaaaatatctagtcaagaagagcctcttgtaacgtctactcaaatcgatgatgctcgtacggaagaaaaaacagcggcagaagaagatcccgatacatctgggatggaattgacagaacctatagtggcgacaccggatagtaacaaggcttcacagcatgatcccacatcaatggaaatgactgaagtttttcctcggagtatcagacagaaaaatccagatgtagagggagaaagcattgagtcaagtcaacaaatcgatgatgtcgaggcagtgcgagaggaaacaatggaattgacggccatacataatgtacacgactatgattcaatttcaaaagatacagtagagggcgaaccaatagatctgacagaatatgagtctaaaccttacgttccaaacagtgtctcacgcagtaccgggaaatcctctgactatagcgtggaaagaagtaacgataaaagcgacctttcaaaatctgaaaataagacgaattcctctcagccgatggaaattacagatatattccatgctgatccacagaaccctatgagtctacacagcgacaataacatcaataatgatggtaatgagatggaactcacgcaaatacagacaaactttgaccgcgacaatcaccacattgacgaatctcccagcgaaaagcatgcgttttcttctaataagaggcgcaaattggatactgtctctgattatgctgcatcggttacgacaccagtcaaagaggcaaaggatactagtggagaggacaatgatggtgatttagagatgatggagaaaatgtcacccattacatttagcgatgttgataataagattgggacgagatccaatgatgtgttcactattgaacccggtactgaggatactggcatgcaaaccgcgacagacgatgaagaagatggggaaaatgtcgatgataacgggaacaaaatagttgagaaaacaagactccccgaaatagacaaggaagggcagtctggtatagccctgcctactcaagactacactttgcgggaatttataaatgaagtgggggtagggtttttagataccaaactgatagatgatctcgacaagaaggtcaatttcccgcttaacagctttaattttgtggagaatcaaaggatagataacgtattttctgccttctatatcgatatacccattttagaagtggaagcattcagatgcaaggagctttggagaagtattaatgaatccaaggataaattcaaggactttgaggcccaaattgataaatcccatccccctcttctgctccaggagtatttttcctcggatgagaaaatgaagcaattgatgagggaccagctacagttggtcaaaggatattcgaaattggaggcagcaatggaatggtatgaatggaggaaaaagcaactaaatggtctggaattaattttggcagaaaatttgaataccttgaaaagggagtacgaaaaattaaacgaagaagttgaaaaagttaacagcatcagaggcaaaatacgaaaacttaatgaagcaataaaggaagagataaggtccctaaaaaacttaccatccgattcttataagcctactttaatgaatagaataaaaattgaggctttcaaacaagagttaatggaacattccatatcgttgagttcttccaatgattttacccaagaaatgcgttcacttaaattagctattgcaaaaaaatctaatgatatactaactttaagaagtgaagtcgcctctatagacaagaaaattgaaaaacgaaaactgttcacacggtttgacttgccaaaattacgagatactctcaaaattttggagtcattaacgggggtacgctttctgaaattctcaaaggcaacactttcaattgcatttcttcaactggatgatttgagagtggatattaatctagcaaactttaaaaataatccgttaagttctatgaaagttatgaatgacagcaataatgacgatatgagttaccacttattcacaatgttgttgaagaatgttgaagccgaacatcaagatagcatgctttcgaaccttttttttgctatgaaaaagtggagaccattattgaagtatataaaattactaaagctcttgtttccggtgaaaattactcaaactgaggaagaggaagcgcttttgcagttcaaggattatgatagaagaaacaagactgcatttttttacgttatatcccttgtctcatttgctcagggcgtattctcggaaaatgggcaaattccaatgaaagttcacataagtactcaacaagattactcaccgtcacgggaagtcctctctgacaggataacccacaagatcagtggagttcttccttcatttacgaaaagtagaatacatttagagtttacgtaaagtgtttataataggacaacgatgactagtaatatctcatcacttttttttagtttttgacgaaagatttttaactgccccgccggcaggaaagttcaaacaatttgaagaaaagctcgaaaaaattttggacaaaaacaacaatcacatcaccattggaaagataaaaaattagaaagaattaactcgtttgttgtttcctgttacctatcacaattattattgctttttagaaccacaagcaaaggagaagcagtagccaccttatgtttaataaaagtgtaaatagtggtttcacctttggaaaccaaaacacatccacaccgacatccactccggcacagccttccagttcccttcaattccctcaaaaatctactgggttatttgggaacgttaatgttaatgcgaatacttcaacacctagcccatctggtggattattcaatgccaattcaaacgctaattctataagtcaacaacccgccaataattcattatttggaaataaaccagcacaaccatcaggtggcttatttggcgctacaaacaatactacttctaaaagtgccggaagcttattcggaaataataatgccacagcaaattctacgggctctacaggtttattcagtggtagcaataatatagcctctagtacccaaaatggtggtttgtttggtaatagcaacaataacaatataacttctaccacgcaaaatggtggtctgttcggtaagcctactacaacccctgctggtgctggcggcctgtttggaaattcctcatcgacaaactcaacgacaggattatttggatcaaataatacacaaagttctacaggtatttttggtcaaaagccgggagcttcaacaactgggggattgtttggaaataatggtgcttcattcccaagatccggtgaaactactggaaccatgtcaaccaacccatatggaattaacataagtaatgttcctatggcagtggctgacatgccaagatctattacgtcttctctatcagatgtgaatggcaagtcagatgcggaacccaaaccaattgaaaatagaagaacatattcgttttcttcctcagtttcagggaacgctcctttaccactcgcctcacagtcaagtttagtgagtagactaagcacgagactgaaagccactcagaaaagcacgtcaccgaatgaaatattttcaccgtcttacagtaaaccgtggctgaatggagcaggttcagctcccttagtagatgactttttttcttcaaagatgacttctttggctccaaatgaaaacagcatctttcctcagaatggttttaatttcctatcctcccaaagggccgacttgacagagctgcgtaaattgaaaattgattccaacagaagtgctgcaaaaaaattaaaactcctctctggtactcccgccatcacaaaaaaacatatgcaagacgaacaagattcatcggaaaatgagccaattgcaaatgctgatagtgtcactaacattgacaggaaagaaaatagagataataatttggataacacttatttgaatggaaaggagcaatcgaataacttgaataaacaagacggcgaaaatactttacaacatgaaaagtcatcaagttttggttattggtgttctccttccccagaacagctggagcgtttgtcattgaagcaattagcggccgtttcaaattttgttatcgggagaagaggttatggttgtattacatttcaacatgatgtggatctcacagcttttaccaaaagctttagagaagaactattcggtaaaattgtaatatttcgttcctctaagacagtagaagtatatcctgacgaagccaccaaaccaatgattgggcatgggttaaacgttcccgctataatcactctagagaatgtttatcctgtagataaaaaaacaaaaaaaccgatgaaagatacgacgaagtttgctgaatttcaagtttttgacaggaaactaagaagcatgagggaaatgaactatatatcctataatccctttggcgggacttggactttcaaagtcaatcattttagcatttgggggttagtcaatgaagaagatgcggaaatagatgaagacgatttgagtaaacaagaagacggcggtgagcaaccattaagaaaggtgcgcacgttagcgcaatcaaaaccatcggataaagaggttatcctcaaaacagatggcacttttggaactctatcaggtaaagacgactctatcgttgaggaaaaggcatacgaacctgatttgtctgatgcggactttgagggaattgaagcttcccctaaacttgacgtttctaaggattgggtagaacaattaattttagctgggtcttcactacgttctgtgtttgccacttctaaagaatttgacgggccatgtcaaaatgaaatagatttactcttttccgaatgcaatgatgaaattgataacgcaaaactcatcatgaaggaaagaagatttacagcctcttatacgtttgcaaaattttcaacaggttcaatgctactgacaaaagatattgttggtaaatcgggcgtttcaattaagcgtttaccaactgagttgcaaagaaaatttttattcgatgacgtctatttagataaagaaattgaaaaggttactatcgaagcaaggaagtcaaacccatacccacaaattagtgaaagctctttactctttaaagatgctttagattatatggaaaaaacctctagtgattacaatctatggaaactttcatctattttattcgaccccgtttcctatccatacaagacggacaatgatcaagtaaaaatggcattattaaaaaaagaaaggcattgtcgattaacttcgtggattgttagccagataggtccggaaattgaagagaaaattaggaattcttctaacgaaatagaacaaatatttctatatttgctcttgaatgatgtcgtaagggcatccaagttagcaattgagtctaagaatggtcatttgagcgttttgatatcctatttgggttcaaacgacccaaggatacgtgatttagcggaattacaattgcaaaagtggtcaactggtggttgtagtatcgacaagaatatctcgaagatttacaaattactaagcggttcaccttttgaaggtttattttctcttaaggaacttgaaagtgaattcagttggttgtgccttttgaatttgacactgtgctacggccagatagatgagtattccttagaatctcttgtgcaatcgcatttagacaagttttctttaccctatgatgatcctattggagttattttccaactatatgctgctaatgaaaatacggagaagctctataaggaggttagacaaagaaccaacgctttagatgttcagttttgctggtacttgattcaaacattgagatttaatggaacacgcgttttttcgaaggaaactagcgatgaggctacattcgcatttgccgctcaacttgaatttgcacaattacatggccactctctttttgtttcttgctttttaaatgatgacaaggcagcagaagataccataaaaaggcttgttatgcgtgaaataacattgttaagagcctctaccaatgatcacattttaaatagattaaagatcccttcgcaattgatattcaatgctcaagctttgaaagatagatatgaaggcaattacctttctgaagtacaaaatctactcctgggttcgtcttatgatttggcagaaatggctattgttacgtcattaggaccaaggctgttgttatcaaacaatcctgtacagaataatgaactgaaaactttgagggaaattcttaacgaatttccagactctgagagggacaaatggagtgtaagtataaacgtatttgaagtatatctaaagcttgtgttggataatgttgaaacgcaggagactatcgattcattaattagtggtatgaagatattttatgatcagtataagcactgtcgtgaagtggccgcatgttgtaatgttatgtcccaagagattgtatcaaaaatattggagaaaaacaatccttcaataggcgattcgaaggccaaattgcttgagctccccctagggcagccagaaaaggcatacttgaggggtgagtttgcccaggatttaatgaagtgtacatataagatataagtttttttatttttatttctaaaaaaaagaaaaatagtaaaacatggactgaagctaacgcttttggagtaattagtagcattatatatggtaaaagtgttcttcagtaggtctaagatttaaaggtaatgatatttatattataaaacgatttgacctctaatgcacttccttttattctttttgataaaatatactatacatcccccacagcatctcgcagagcctccacaacgttaagtacagcactcgaagctgggctgtcaggatagttatccaggaaactttcacccatgtcacaactcttgccaatcctcggatctaacggaacagaccccaaaaatttgatgcccaattccttacaaagtgcttcacctccacctgtggtagccttgaatatttgggactctcctttgcaatttggacatacaaatccgctcatattttccactagtccaagaatattgataccagccttcttacagaaatctatctctttccgtacatctaataaagctacttcctgaggtgtggtgaccacaagggcaccatctatgccagattctctcatatacttgtttattgaaatgtgctcatcagatgttccgggcggtgtgtcgattaccaagtaatcgagtttatcccaatcaacatcctttaaaaatttttttatcaataaattcttttttgaacccctccatataatggcggaatcgtcttctggaagcatatattgaatagacatggtggctaaattatcagtcacatagacaggtgtccaaccggagttcgattcatggacggtttctttaatgcagcctaacatatgtggcaaagaaggtccacatatatctaaatccatggcacctacttgtaaatcttcgtcagctgaaagtgcccaacttagcattgcggcaaatgtcgacttgcctacgccacctttgcctgataaaaccaatattttatgttctattcctgacaagttatctgtgatcaatggaatatctggatcagggcctttcggaagactttcacatatttctttattggcgcagccaccacaagcatcggacttacctgccatgtctgattctggaccaggacagtgttctggttccggctgattaagttcatactctgctggtagcacttcgtcgtttacatgtggtagtatctcagtcattcttggatatcacttatgtatactgttgttctcaaaaacagaaagacttcacgtttagcctagcctacgagttgttggacaaacatgttatttattattatatacaaaatatttctacgcattactaattacaccattaatgaatccgaaaaagtacccggaagcgtattttgaaaagccatattaaagaataataagatgaacggcagttttcgacgtgtcaatgcatagaactgagagaattgtgcattggatgacttatttatgtagggtgctatgtcccagctgacggagttcattagctgtatccctgtggttaatgaagaacaaaatgaagaagatgagcgtggcctctgtaagattcagattgaagatggcgctatgttggaaacattagatgagaacagtctttcagggcttagaatagagaaaatgttggtaagtgaaggtacaggaattttttccaaaagcagttttggaatcaatgatttgcgaatctttacgggagaaaatatcgatgaagagtctaagaaatatgtgtggtatgaactactcaaaatgttaactggtcacaaagtgtacattgcatcgttagacgaaaaagtcgtattcacaaaatggacgtgcagaatgcaagatgatgaggtatggaaagtagttatggagttggagtcatcggcgatcataagaaaaatcgctgaacttaccttgcatccagtcaaaaagggagagattgatttatttgaaatggcagataaactctataaagatatctgttgtgttaacgattcttaccggaatataaaggagagcgattctagcaatagaaatcgagttgaacagctggctcgggaaagggagctattggataagcttttagaaacacgtgatgaaagaaccagagcaatgatggtaaccttgttgaatgagaagaagaagaaaataagagagcttcatgagattctgcgacaaaataatatcaaattgtctgacgatgatgttttagattctgcgcttattaatacggaagtgcaaaagccaatttctgagttaaactctccaggaaaaagaatgaaacgaagaaagacggtagtagagcctcaaaatttacaaaagaagttgaaagacacaagtcggaggagagctaatagaaaaatatctaatcaatccgtgatcaaaatggaagacgacgattttgatgactttcaatttttcggactttctaaaaggccaattattactgctaaagataaactcagtgaaaagtacgatgatattacctcttttggagatgacacacaatcaataagttttgaatctgatagtagcagtgatgttcaaaaacatttagtgtctttagaagacaatggtattcaaatatcagcaggaagatcggatgaagattacggagacatttctggttctgaatctgagactgatgcaagtgcaggggaaaagaagagctccaaccatagtgaacaatccggtaatgatagggaaccttgcttgcagacagaatcggaaacggatatagaaacatagcctatttatgaatgaatgtaatatatggcaaagagtattatagtatcgcatcatttgagagaatactttatttaaatggcaaaaaatagttctatgtgagtgatcgaaaactcaactactcagattgaaaagaaaataaataaaactaggtgttgtatgaacgtgaaagaaatcgagagggtttagaagtagtttagggtcatttttcagtacattggttggcctggcttgagttgcaaccagtgccaagcatcagcgttggcctctctcttgtacattggttggcctggtctcaaatttaaccagtgccaagcgtcggcaacagcctctcttttcgccaaagtggtgttttgctctttttcagccgcctcagcaatagtggtgttgataaacaatagcccactggcggtagcgttactgaatggtaaaaaagctatgtcatgatcacctccgaaatccaagtatccaataatggcctcggctggcacctgagcgatatcttcatcggaactagcagtgacagaaacggccgctaaaataaaagtgagaaaggtagaaatgaatttcattttctccaatatgtgaatttactggaatttgatgcaggtgatggtagtaattatccattatatagaatataaaaacagatataggaaggacacctcaaactacaccagaatcaaggacagcttttatacatataagccctcgtctctgcgctgtaaagacaccaagtttcactaggtccacggcgactctgtactgaaacaactgaatatttgaaacagtaacgatgaatagtttggctcgataccttgaaaacaatcactacaggcgtcgcccagatgcgcacatcgttgctggcattgatgtaccaatgaagaaatataagtgacaaactttatgaaaagatagaaagaggtttacaagataagagaaaaattatgctgtgaagattagtaatcgaagtaactgcttattcattcagtgcatgtttttctaggaatgcgtttgatatgggacatacatcttactatgcgacattaccttttagggacatcaatgagcaagtgaacactagcaaattaggaaaacaactttagcacgcccaactgcgtactgaaacgcagaaaactatagagtttcccgaaacggtgacagctgagttcgctcaaataagaacaacaccatgtcttgaagcttcttctatagcgtagagtaagtagtgccttgtagccctaccgttttacaatgcatgaggttacccgcacttattatttttttctctttttttttcttagctataaaaggcagatcaatgcagcattcattgctttatttgactttcctttactatttatttactttccatttcttattttagtgttattttataacagtaacgcaaatttaacagccattcgtaacacgtacagtatctcgtcgaggttgaacccctccggggcgttcttgacccatgaagaatgtggattggtgttgcaatatatttattattggcttggactggagaacaaatttatcgatcttgggtgcaacagtctttctgtcgtctgttttttagcagatctaagggtttaccttcgtgtgcccggatgaggaccgttgcaaggattgataatacaactatatacatcattatcgtagtgaattgcacgagtaacttctcggcatggggtgagtaaattcatattatgaaagtaattaaacttactacctaaataagaggatatctatgtcttattgcttgtatatatgagtggcttggaatgctgcaaatactgtttaggaaaaagtagataactaaaaggtttctccttccttcggttgacgcaatttcttgttcgctggggttgccatttcctttctaagatcaagtaataaagtttccatggtgtaggctcttttccagtcacgtaaggtgtggaagtcagtttggacctcccccgtagttggattgacgcatggtagatttatcttggaaatgaaagtgacctttgggggagaatctggatagtttgggccacaatctatagaaagggaatagattctgttttcatgattactatgagggggccctaaaatagtgccgttccatttggtcatggtaatatcgtcgctatcagctaaaccataactacatgattctggaccaaaccctttttcacccttttctaattcttctaacaacctaaaatttcttggtctgatttacaataggacagtgagggtacatttcaagaatttgttagtatatgttgaaatccctttcaaaacttataataacatacacttttgacatttttgtgtaaacgctgctttcttctacgttgcatatacagaataagaatttcaccacgacatcgaaatgtaatgagcagagattgtgtaggaagttgatcttattttagtctcttatttatcgctaaaggagcaatgaaaattgatagcgtgttaccctaggaataattcctaacaattttttccatcttaaaatcgagaggtaatagtaaataatggatgtgagagcggcattgcaatgtttcttcagtgcattgagtggacgattcactggaaaaaaattgggactagagatctattctatccagtacaaaatgagcaatagtggtgggtcctctcctttcttggaaagccctggaggttcgcccgacgtaggcagtacaaatggacaaagtaatcgtcagattcaggcgttacaattcaagctcaatactctacaaaatgagtatgagattgaaaaattgcagctacaaaaacagacgaatatcttagaaaagaaatataaggccacgattgacgaattagagaaagcattgaatgatacaaaatatctttatgaaagcaatgataaattggagcaagagttaaagagtttgaaagaaagatcagctaattcgatgaatgataaagacaaatgcatagaggaattgcgaacaaccctccaaaacaaagatttagaaatggagactttaaggcagcagtatgattcgaagttatcaaaggtcactaaccaatgtgaccatttcaagttggaagcagagagctctcattcgctactgatgaaatatgagaaagaaataaagaggcaaagtgtggatatcaaagatttgcagcatcaagtgatggaaaaggatgatgaattatcttcggtaaaagcatctaagatgataaactcacatccaaactactccaccgaagagttcaacgagctcactgaaatgaacaaaatgatccaagaccaagttcagtatactaaagaattggaactagcgaacatgcaacaagccaatgaattgaaaaaacttaaacaatcccaggacacttctactttttggaaattagaaaatgaaaaactacaaaacaaattaagtcaattacacgtactcgaaagtcaatatgaaaatcttcaattggaaaacatagatctaaaatcgaaattaaccaaatgggaaatttataatgatagtgacgatgatgatgataacaatgttaacaacaatgataataataataataataaaaatgataataataatgataataataatgatacaagtaataacaacaatattaataataacaacagaaccaaaaataacataagaaataaccctgaagagattatccgggactggaaacttaccaaaaaggaatgtttaattttgacagatatgaatgataagttaagattggacaataacaatttaaagctactgaatgatgaaatggctttagagagaaaccaaatactagatttgaacaagaattatgaaaacaacatagtaaatttgaaaagattaaatcacgagttagaacaacagaagagtttatctttcgaagaatgtcgattactgcgcgaacaattagatggcctatattccgcacaaaataatgctttactagaggtcgaaaatagtgaaacacatgcgtcaaacaagaacgtaaacgaagatatgaataatttgatcgatacttataaaaataagacagaagatttaacaaacgaactaaagaagctaaacgatcagttattatcaaattccaatgatgtagaaacacaaagaaaaaagaggaagttgacaagtgaccaaattggtttaaattattcacagaggctcaacgaattgcaactggaaaatgtaagtgtctcgagggagttgagtaaagcacaaactacaattcagctactacaagaaaaattagaaaagttaactaaactaaaggagaaaaaaatacgtatactgcaattacgtgacggccccttcataaaagatcaatttatcaagaaaaacaaattacttcttctagaaaaggaaaatgcagatttacttaacgaattgaaaaagaataatccagcagtggaaacagtacccatttctgtttatgattcactaaatttcgagttgaaacagttcgaacaggaagtttttaagtcaaataaaagattttccagactaaagcaagttttcaataataaatctttggagtttattgacgttgtaaactcattattaggttttaaattggaatttcaacaagatagtcgtgtgaaaatattttcctgtttcaaacctgaaaaatatttgattgctgatctaaatgaaaacactttgaaatctaaccttgatgcagatatagaaggatgggatgatctcatgaatctatgggtggaagatagaggtcaacttccgtgctttttggcaacaataacattgcgtctgtgggaacagcgacaagccaaataagtgtatatacatttctaatagataatagtaatcggttttataatatgataaactcctatccgctgacataattgttggtcacaaaattcttttatctttcttcatcattgaccttttatgattcctttggtatgcaaaaaaaaaaaaaaattgtgttgaagaataaaaacaaattacagaataagtcacacatgatataaaaagaagcccagtatttcatagctattaagggggcataaatgcacttatatgagggaaggtgattctaattcaaaaaaatctgcggatgttgctgtcctctccatcatccttacgggttcgaccttaacattgatctacacatataaaaggtatttaactcaattcaaaagaacaaatgatataccgcgaagaatatttcgtaaacactggctttatggtaaagtcacgtctgtaggtgacggggacaactttcatttctttcacatgccaggtggtataagaggtggatggggatggttacgacccgtcccacaaatgatcaagaatgattctacggcagaaaagcttgttggagatagcagaaatatgaggtttttcaatttcaattggattacgcatgggaggtccaccaaaagtaaaatacaaaaagctaaaagccagttcttgaagctaaatgtaccttacaaaaataggaaaaacctgccaactattcctataagattatgtggaatcgatgccccagaaagagcacatttcggtaacccagctcaaccgtttggtaatgaagctttaatttggttacaaaaccgaattttgggaaagaaagtatgggtcaagcctttatctatagatcagtacaaccgttgtgtagctcgagtgtcatactgggactggtttggtgggtggaaagacttaagcttagaaatgctcaaggatggattagcggttgtttatgagggtaaagtaaacacagaatttgatgatagagaagataagtatcgatattatgaatttttggcaagatctagaaaaaagggactgtggatccagaataaatttgaaacgcctggtgaatataaaaaacgtatttgagttttcgagaggatttttatccatcatactgcagattttcatattatatgttcattagcttttcacgcttcctctcgataattttttatttattttcggtttcatttttgtactagtagataaaaatacatacatgatagcagtgttatacaattgatattcgtaaatttggcattcagcattttaggtaaattccgtgcctcttttcttcttctctgatttcaaacattatttgtactgcgatgaataaactaacgcttgccaaacttacaaatttgaaaccagatacggtacagaacatatcgcttagtaattttttagtaccgtcagagcccaagcagaatccaaaaagattagcgatcatcataacccatatgttgaaaacagcaccgacagcgcaaacgtgtctgtaccagactgcgtcggtataatgagagaaaatttgggtagcaaaaatttctggtaagaggaacaaaactattagccaaccccataataataactttagttcgatgtcatgccatatagctacgaaggaaaagactgctagtgatgtcaaaactctattttttgagccacctagaggaatatatatgtaacggacaacccacttattgtagctcctatgccaagctctccagaatgctagtgaactgtaattgttatcaacacacctgatcatattttcaggtgtatcgattccgtctagcaaagcccacagcctaaacagcctccacggaatcagtagttttagccaaataatattcaaattaaataagccaatcatggaaatctggaaaggtgtgtcattttcccacgctttggtttttgagattgccacaacgtagagaaagtgtaaaatgaactccatagataagagagcaataacgaatctcaccgcatagtaaaaaatgaatttgaaatttattgatggcaaggtatgtttcgattggtaaacataatcattgaatgttataatggggccggcaatgaaaagtggcgtgtaagtaacatatgcaatataattcattaagctgtagtcctgtatggggtgtgcagcagttaatctagcacgttcattgagcaaaatggctgatttagcttcttttgattcataggatggacttttcttcttttgtaaattctcccacctctctaagaagtccaagttgtaacttaagactctcaaaagagtaaaattgaaaaagacatcccatcttggaatgatacctctataccaatgatccaatgggcttaaaaaagagcaaatattaccaaatggatatgctctgaagttgtcgttaataaaaagcgtagaaataccataaatccaaatgctgatggtggctattcttctaaagttctttagtacatgggcgatggcatataaaattagcatatgggctaaaattcttatcgaattgacaccatgagcggccactaaaaagatcaaaccaaatatcagatcaaacctcaatttagtgatatttgttgaataaagtacaatgcgttttatagaagtgtggactagcattaaaactgacaatagcgcaaaattgtccctgaaaaacctatattgagaatcactattgtctacttttctgccaaataaccaaccttgagataggagacgttcgtatcttgcatagtttggattttcgggcgaactagcttgtaacccagcatagaacatcaagggaaccacgaccagaaatgcaatgtagtagaatttgaactcagtagttttccatagtgatggcttagtggtagtagaggcatccttttttggtgaaggtttgattcttgaatctaagccctcggaagtaattaggggagacaggatgctgatcagcgacatttcttgcaattgtctgttaacaaatgctgattcacgctttgtttttgcctttgtatgattaacatctatatatcgaaagcaatatgctaagttattattcttaccctttcagtgtcctttttggcacacccactaaacataaagagaaatacgtgaacacctatacaccctatattattttgattgttcaacattgcttgattcatcatccattctccagctctcgaatcttgtttctggcttttccaagattatgtgaaaattaacttactctttttggtcgataaataattacaagttcaagtgcatgtctaattggaaacttatttttatgtccgattgagctgatgttcagctagtttatgtttatacaagaaaaatgctcacccgtacatatgctccttcttcactcattttcttgtcctgttgttgagacattcaactttgatcctgctcttgtacttttatgattcattacttatatattggtcttcattattctcgagatgaaattctcagggtcttttaaaaaaaaagtttcagtaggaaaactaaacgtaattaaactattcttcggttcgaacctgaagttgcgtgaaaaaaagggtactgcagtcttgaaaaaatagaagccaaaaagaagttaatatcaaaacaaataaatcttgcacatattaaagcgcacaaaagtattcaaaacagtgtaacttcgaatatcgtatcattaaggaaaataggacacactttgattgagcagggatgatgttttggtcctcaaagacgggtatcacgtcaaaatattcattttcatcatcacctactttcacagctgaaccatggagcatttacaccggtcgtcccaaatcttcatcttcatcttcaccttccaaagtatcgatattcatgtttgacaagaagcagttcgaaaactatttgttacactatggtattattaaatccaaatctggatccagagataaagtattaatacaagaagcgtacgaaatattaagaaaccaggccaataacttggccaagctcaagcacccaaatattctgactttaattgaaccattagaagaacatagcaagaatttcatgttcgtcaccgagtttgtcactagctcattggagaccgttttcagagaaaccgatgatgaagagcagaatttcttacaaggtcatgttaaagataatatcgtggtacagcgaggtatattgcaactggtaaatgcactcgattttgttcataaccgcgcaagctttgtacacttgaacattcaacctagggcaatatttatcaatgaaaattctgattggaaaatttccggcttaggctatttagtaaaaataccaccaggcacaaatacctctgaatacttcttacctcaatatgatcccagagttcccccatttatgcatttacaattgaattatacggccccagaaattgtttttgagaataccctaacctttaagaacgattatttttctttaggattgttgatatattttctgtacactggtaaagacttgtttcgcagcgaaaattcgactagtgaatataaattggagtacaacaagtttgaaagcaaaattagtacaatgtcatgggataatatattcagtaaggttccacaaaagttgaggcattgtatacccaagctaataaacagagacatctattccagatatgataacataacgttgattttagattctgagtttttccaagatccgttagtcaaaaccttgaattttttagacgatttacctaccaaaaataacgaagaaaaatacgtattcttagagggtctcgtgaatctgctgccagagtttccgccagcattattgcaaaagaagttcttgcccattttattggaactattaagtcagttttgtgctgagaaggtcgtaagtgataaatgtgtgggtaaaagtttggatttgataatcaagatagggtccactttatctcagttgtcctttcaagagaaggtttatccagttttattgagtgatgcgaactttccagtattattaaaaaaagccaccatctgcctgatcgataatttagacacattgaagcaaaaagttaaacgctctgatttcttggaaaatatactcaagccgctatttaattatgttttacatgactccgaaagtgacattaccgtggtttgtcaagaaaaacttttatcacaaattccgttagctttagaggtacttgattttcctaccgtgaaacaattcttattaccattactatccaatctatttacaaagacaacaagtttaacggtgaaaaacacatgtgttacgtgctttcaaattatgatagagcataaatccatcgattcttatacttgctcagaaaccgtcttgcctttgtttaagtccatgaaaacaagagatccaagaattttatctaagttattgaagctttttgaaacggtgccgttgatcattactgatgaaattgttcttgttgaccaagtactgcctttgatgtggaattattctatggcttcaacgctaacaaagtcacaatattcaggatatacaaaggcaattaacaaaatgtcttcagacatccaaaagcaccatatcgccaaattggatgataaagtcaatgatattggcgaagatgcctttcacaaagtcattgaaccaacaatcatgaagaaggaggaccctgagacagttgcagctaaaaatattgaagtagcagccatgcaaccagttaaaaaaaagactgggtcctcttatggggagacattaccacaatctaaaagtattttaaactccaaacccctaaatcctaaaaatgcccttgcaactagaggctttccaacaaggattctaaactcccctccacagaccccatcaagtcgaactggttcaaaagttatgaccaaaggtggctccaacgacgcttcgagcactaaggtggaagaggaattcaatgaatttcaatccttttcaagcacagggagcatacgtcaaacttccgcaccatcagacgtctggatgaacagtacccccagccctaccccaacatccgcaagtagtaccaatttaccgcctgggttctcgatatccttgcaaccaaacaaaagaaaggatggttcttctgatattccccgaagtaatgtatatggatctttgatataatttgtcagcctcccgaagatgaagatatcttaaattggcttgaaacgaacgcaccacgaagtcagtggttctttgtattagtaaataaaccaaatataattttgtaccttagcagctctttcgagaaattcattttcagtttagtaggcctgactgacaagcaaattgttcttttttctggacggtgcgggatcaggggaatcacacgttcaataaataaagaaaggatgaaacagtcgtacaacaaccaaacatgaaggaggtacagaggaagcaaacaaaaccaaatttgctaaaatcaagactggggcaatttttcagtccgtatacaatcgttcacaggaattagccaatatggatgttacatttctaaccaaaaatgttcaaataaatggcactcagtttaaaatattacttcaaaatgggcaaggtgaatgcgcgctaattgcactagctaacgtattattgatatcacctgcccatgctcgctatgcccaagaaatttccagactagtgagaggcaaggaaactgttactttaaacgaacttgtgcaaactctagccgacatgggcgttcaaaatccgaatggtacagatgtggacaaacaacagctactccaaatcctaccacaattatatagcggattgaacatcaacccagaatttaacggatcttttgaggacggcgtagaaatgtcgattttcaggctctacaatgtcggcatcgttcatggatggataatagatggggacaatgatccgaactcttacgaacatgtgtccaaatattcttatatgggcgcgcaaaaagttttggtacagtcgtatgagatccaaaagaataatgcccaatttgaaaacagcgagcaaatccaatctgatgcaccttacttaaaatcgtttctggcaagatctgccacacaattgactgaatatggtctaactcatctcagagaaattttagtagaaagatcgtatgccgtgctttttagaaatgatcacttttgcacattatataaaaacaatggcgaattgtttactttggtcacggatcctacttacagaaatcgcaaggacataaactggcagtcgcttaaatccgtgaatggatcgcaggattcttactacacgggcaacttcattcccacaagtctggaaagaacagaaactactgctaccgggcaaaatgagtcctacatttctaacccattcagtgaccagaatacagggcatgtaactagcaaccaagttaatagtggagcaagcggtgttcaacaaatcgaagatgatgaggaactagctaggaggttacaggaacaagaagatatgcgtgcggcaaataacatgcaaaatggttatgctaataacggtagaaatcatcaaagggaaaggtttgaaagacctgaaaaaaattcaaagaaaaacaagttccttccctttaatgggagtaataaagaaaagaaaagagacaagttgaaaaaaaactgtgtaattatgtgaaaccatgatttctttttcgtcttttgtatctttcttatagaattattttttttgtgggtgtcaccacgctagcgcttatttttaactctaccactttttaattttgtaaatgtatattttactccttcatggcgttcaactggcctatttgtgatatataacctgataataccaatgatttatttttttttacagattccttctcctaaatttgtccaaacaaaacggctcaagaagccccgaataatgcactacagcggaaattaacatttttgggatatcttcacagaatactaaagcaatcaaagtggctcatagtattgagttttacaaattacttgaaaaaaaaataatcactaggcagttgcataaagttgaaactgagggaaggaactggggaaatcatgggtgatataagaacttttgttttcgctatagaagatacggaaacaacacaaggtttgtgtaaaaccattggccgttcgagttcatttgatcaaaatagtctatgtaagccgtacaatctatattttgatgagccagaactaagcagacagcatgctgtcctatgtataaagacaccaatacccaaaattgaaggagttccctctatagaacaactccgcatctgcattcgggatttgaataacaagactggtacagtaaacttagtgtctgatgggccaaatgatgaaattgatttgaaaaatggtgatgcttttggtttgattgcaattgataatcatccttttcgcgacaaccatcatttagccgccaagttaattttccgaattgaacttgagtatttcgatgaagcaagggaaatcgtaaagtgcactattacaaatgtaacatttggaaagaataatacagtgtcatctttccctattcattctgcaacatccacagaagatagcgattcaagttggtacggattgtcggaagcgagtacgcaaacggaagttgcagatgagtgtcatgaaacgaacaccatattgactcgaggtggtaggttttctatcctttcgttgagaaaaagaggcagcaagcaagaccagaagatctgcagtaactttgatagaaaaatacatgaaacgagttctttcgaagaagaaatcgaagtttgcactgacacagacaccacagaagaaaaagaagaagaagaagaaaaagaagaaggggatgatgaggaaggagaaatagaacttgaaattattagagtaaaaagaataaagggcaggacgaagataaagaagacgcttacttgcttctcgaaaaacaagaaaattattacccctcagcactccaatagtatgtggttactactaatagtaatcttgatttttgaccgcctactatcgaattaaatataattttataacccagttctatattgctgggtggtattatagcttcatggctagtcaaataagtggagttttttgctctggacgtggcctgtaaagttctcttttgcgacggccccccgctttaaccgaggcgaaatgacaagtgctttctggcaaagaaggaatagccactacaacctgcggtctccacctttctccaccgataatctatttaaacactcacttgccaatcagcaaacgtcaatacatctacatatatacgtatagattttattgcactgtgatcaaaaagaatgtctcaaccggttcaacgcgctgcagcacgctcattccttcaaaaatacatcaataaagaaactttgaaatatattttcacaacacacttctggggtcccgtatcaaatttcggtatcccaattgctgctatatatgatctgaaaaaagaccctacactaatctctggcccaatgacttttgctttagttacctattcaggtgttttcatgaagtatgctctttcagtatcacccaaaaactacttactgtttggatgccaccttattaatgaaactgcgcaattagctcaaggctataggtttctcaaatacacgtatttcacaacagatgaggagaagaaagctctagataaggaatggaaagagaaagaaaaaactggtaaacagtaaaacgagcagtctaagaacctgaagtaggtgactagatggaaacataaaaaagaacaagcaaggattaagaggatggatatgttcatgcatattctctcatttttacctcttctccttttcatatatgcatgctatagaaccattatctctatgagtttcattttatttagtagttagtattgaaccaaactacataagatgacatattctaaataacctaaataattattatgtctttattcaaatatttcttttatatccaagacaatttccctctcatctcctttgtattactgattatattcagccattcaaaaagttaaaaaagaacgtttttcactgaaaagtcgcagctatattatagtaaaataataagagaggcaaaataatggttaccaacacttagtgaagaacaatggtgaccggaatatcggaggaaaatgatgatgaagagactttttcggctgttcattcttcaacacccagtattaattctcaatcctacgcgattcctataacagaggaaatgtccagctctttccatgattcgatcagcaccactagcaactcaagtggtagcttcgatagtgatggaagtaacgtttcagatgttgtggagcaaaatgaaatggacaatgaatctaacgttgacgaagatttgttcctagataacgatatccctcagtcaagcaatttgctacccacggatgcccaggatcctggtccaatatttgacgtttctagatatatttttgattctctaaaacaatctattgattctgctgatttctcagaggcactttctctacagaccaaaacctccgctgttataaattcgaaaagcctagagcttaaacaatatattgatgaaatgaagagcaggctcactcaactgcaagagaagtttgaaaatggtgaggctacttcaaaaaaaataaaacgtgatttagaaacttcaagaaagaacatcgactatttaaacgctgctttgcgtgtcgatttccccatagagtttaatcaggcaagagaaaaaattcttgagcgcagattgaatgaagaccatgactgctgatatactgaatcgtattttttttctagaaaatatgtatactatgtgagagtcaatttaaataatattaatgataaatgaaagtgggcagttataatagtaatatacagtgttttgttaataaatctccgactctcgattggctattattagagaagaaaatccaagattgaagtaaacgaaaaaacccctaatcgaaagtaattttttttggtttcttagtcaaatcgacgtccttaaagaatgaaccataagcgctatgttccttcttcttagtgtgagtaccgaactttatcaaatcttcaggaacaggttgattggcaccattcaaaacgttaaccagtccaccagccaaatgcttttcttgttcagtgaacagagtgtgtgctgtgcctgtttgaccagctctaccagttctaccgattctatggacataatcctccacagtcaatgggaaagttaaattaataactgtcttaacatttggtatatctaaacctcttgctgcaacgtcggtggccagtaacaagttagacttcccgcttttgaactcattcaatgcttgcgttctttgttgctgggacaaatcaccatggatagctgcgacgttatacccgttatatttcaaattcctttcaacacgagcagcttccttcttataaagagcaaaaatcaagaccttttcattcttttttggaccagagtggtactttttcaacagttccaataactttctttcttttccacgtgggtccaccacttcaacaatctgtgtaattcttttgttagcagttagttggtccgtgttaccaatagatactttgattgggttgttcatgaacgtggaagctaattcacggacttcctttggccaggtagcggtaaacattagagtttgtcttttggacgcatcagtttctctgataatattcttgatgtcttcttcaaaacctttttccaacattctgtctgcctcgtctaatactaagtaattaacttgagataagtcaacagatccttcctgcaataggtctaataatctaccaggtgtagcaaccaccacttgtgacttttttaactgaattctttgctcatcctttggaacaccaccataaacacaacaacactgcataccaaccttgtcagttaatacaatcagattatcataaatttgggaagcaagttctctagttggggaaatgactagaacctgtatgccccttttcttttgatcgttcattaaatggctgatagctggaacaccgaaagcaaatgttttaccagaaccggtctcagcaacaccaacaacatctttaccagataacaaatatggccaggctacggcttgaataggcgttggttttggaaatttggaaatttctgcttgaatggaagagtctaaagaaagataatcaaatgataatagcggacgtagggctagatccagagaatcctcaacagcaatttcattttccttgaaatattcgtcaatatcagattgtggaagactggttagtgcttcactctgaacataaaactcactagccactgcagaagtaggttcaggtttcttttcagattctttctctggtacttccacttccttctcacccttcttctccttcttatgctttttatgctttttatccttcttttccttcttgtctttcttatcctttttgtgtttcttactcttctttttttcaattacctcctcatctacaacctttctcttcttgtctgcgatttcttcctttgtcattttaatcccctatatatcaaactgttaatacttatgctttcgttaaaaggctgtaaaatgaagttaagctatatctctgagctgctatattgttgcctatctattattaatattttttttttatttgcttcttatgcgatgaggtgaaaaatttttcatctttttcccgcaaaaatatttcaagaaatttgaattacagtcacatcgctttcaagagcgcaaagcctgagggatatttaggttgaaatatcttagtccctcgtctaaaatggcttaacaaaccattaaaaaaaattcacttttattacttctatgcaaataatatacttaaaataaataacggtcgactgatcaacactataaattcacttctttccccacggtacgtgttcattttcgagttcaacgtcagaggccgcaacggaaaattctcgactatcttcaatggtatcgaagttattactatattcagcctgttcgttctcagattcttctaaagcgtggaattccttcttacccttgtatttccagtaaagaatcgaatacgcagtataaccaacaataactacacaaacatagttcatgttatcctttgtcacaggtaaaactggtggaaaggaaaaaaagaccacagaaaagacagtccaacccaaaagaacaatgtttgaaaaaaatccaaattttccaagccagaatggaccatgagctatgttacgctttttagcaagtaaacatataaccggaatgatgtaggataacaataaaaatgcaatacaacctgtaattaaggactgaaaagccgtactggaagccaaataaagtaggccaatgagggttatccaagcgcatgacattaaatgagcgttcaaaggtacaccagtgtgtgggttaacttgcgaccataaacgggataatggaagaccattgtccctggcaaatgaccaacataaccttgcctgccaagtgtgacaagcaatgacgcaaccaaaagaggtaaatagaatcaagcaacccaggaaaatcgcacctgatttattacccaatgcctgattataaatgtccaagattggggcgcctgttgtagaagacaagacagcgtccagatcttgtatagagaagaacatagcgataacataacaaaaggaagtgacaaacccaatggcgactgttcccatgatagcaatgggaataactctttctggtttttcaacttcaaacgccatatgggttgcacagtcaaggcacgaaaatgaccaagctgggttaatcaaaccgacaataaaggcgataccgccgttcttccaacctgtttcattattaaatgtggcaaaaacaaactttgcatcgttgaactttccatgagaacatgccaatacagtaattgtaattgtgaaaaaggatagtagggaaatgtatagagaggaagatgaaatgataggtaaggatttaccgtaacagttgaaaaacatcaagaacaaatgcaacaattcaaagcaaacgaatatatgccatctctttgggatgaattcagggtgcgtcagagcgtacataccaaccacttcggtagcaacggataacgtagttgaagcacttgtgaacacggatcctgcgtaagcaaatgaaccgcacatgtaggccgcaaatcttttgtacttaggaggggcaagcttcaaagaccaccaaaactgaccaccggcgtgcggatatgcggaagataattcacccaacgaggtaccaatgcaaatagaaatcagggcaacaataattataccgtaaacaatcatcatgggtccaccagaagatatacctgcaaccatcgatgtagaaataccgaaccaggaattagtcaaaccgaatccaacaccaagaattgaccacaacgaaaatgactttcttagatgaacttcaccatctgctgctacagcacccttgctatccatatcatccaatggctttatttcctcctcaactcttaagtctcttttgtgcatagaagcgttcgaagattgatccggctgcatatagccaccggaagcattatcattccgaatactcatcgttcttcaaaatactaatttctgagtaaatgagccagttaacactgaaagatattctttctatggaagttcgaagatattataatttttctttatgcaagctatatatgataagcacagacaccttctttccaattgttggtattcaaggcttttataaataagttggctaactttcgttgaaatatcggcagtttagagaagtcaaggccgcttatcttcagttttctattttttttttttcgttatataggttctgcgcatgtgaaaaaaaagagaagaaaataaagccaattataagtcattactgacgaaattataagataaattagaggtacaatatacaaactagtgaataacagaactatataggacttagataaaataagtagttatatgtaatgtgacttcaaccagtttagttcatggacttaaccaatttgttgatgaattcttcacggttaccgaaagaaccaccttggataaagtgcttgaactttcttgggacaccccaaccaccagatgggttggacaacttgaatggccacaaaaagttgttagcttgcttgaagtgtggaccaacagtgatgatttcgtgaatcaaatcgtcaatggacaagataccatacttacccaagttggcttcgatgatagcattgtcggacaatggaactctttgcttgttgatcttaccgaaacctctcttgtagaccaattgtctaatagtagagtacgatgggtaaccgtaagcaacgtatggttcaatcaacttcaatagttccaaagtagccttggtaactttgacgaatgtaccagagttgattcttgtcaatcttagcaattgtagaacctttcttggcttaggtgggatcttgttaatacccttgattctgacaacgaagaccaacttgtgttgagcttcgacgtagtaggaaccagcagccttggcatcacgcttagcttgaatgatgtttctttcagcagtttcgtattccttttggtaagcggcgtttctttccaaaataatggctctcttttccttgttagcctaaatgaaaataaaaagtaaaaaacagtaaattgatgttagtaaaaaaataccagatggaaaacacagtattttatgctaaaaattgttacacggcattatcactcaatggtttttctgacactggaaacacggcaataattgtaaccttaataccttaactctctggtctattttactttctatttcttttcttataatcagtcgaaagatggtgataagttacgacagcatcgtcaatgactagtcgaatatgtattgggatacaatggattttcatcataaaatgagaaaacaaacagaacgtaacaaatagtccattagcctaatgataccacaggtgttgagaatattgcaactgttcgaatgatacttatcaaaattggcgacgcacgtgaactcacatatatcccagtaagaaaatgtgttgcagcataaaatataaatgtaagcaaaagtttaacatacagccttacgagcagctctttcagcagcgacttgttcagcagtcttttgttgagccttagacttcttcaactgagattctggggtcaagatttttctgtaataatacaaataataaaatatttttgttagcataaccgaaaatagaatgaattaggtttgtatgaccatcaagtaaaacttttttctacgaagttacatcgaattgaaaacaccacttttcattcgaatgaagggagtgaaacagagacacttaggaaatgaaaatttgagaaaatattctaatcaaggtcggcgatgaaatttttggcaacaatcaagatatttcaaatttttcctcaaattcatcaactaaaattgtctttgaccctgtgaaggtaatcccctacggaaaatcatcttgtgaatagtcacaagttgaagataaatgtaagtgtgagtgcaaatgctattagagcagaattgctcctttttctcaacgtaacttgcggaaactagtatacttctctggatactttaggaaatagtaataaaatagacgatttcgtatacatactcagcggccattgtgatcttaatttgcttggttggttatttggatttatatgaaccgaagacaatacaaggcagatctagtgtcttgattatttcaatatttcagaaaggatgaagttgtcaaagtgatacagatacagatggcaatgattctcagaagtcgcgtccggcagcgacaaacctgcagaaagaatttcagacaaaatttgaaaaaatatatatatatatataggaaaggtacggatttatagatatgtgtgggtgtttatatgatcagtagctattctctactcaactgatgtgaactggagtacaaattatgcaagatatttttttggccaagctacaaacgtaatacgtagaagaatggataaaatagatgtattaaatatcagccccgaaagatggtgtaatttaagttgacaacatcgcaattttgctagtcactttttggaatgccagaatcggcagtatcatcactaaataaatacatctctttatcctattcctcatcttggatagagagtttacgcatctgagctgtaacatgaaatatcacatgaactcatatgagatataagacattagctcgttattatcaacgctgccacgcacattattttgtgttatgcatatctaaaataataaaacctgtgctattataagtatatatttttgtaacaaaatgagaaaagaccaaggtaaagaatgtgttgctgaaatatcgagttcatcctttttatacttcgaaaggcggtttttttctcgttcatcgcaagggtgacggcagatgtaaaaaaaaaaaaaaaataaagttaggactagcgattgtcgtagacgcacatcaatgctgaattattttgaattgaaggatatcatgaacggtttacgtgactattttcactgtgtatgaagtggcacggtgcaaaggccaaggtttaaatgccgaatactctactatatgcgtcatccacattggcatttgaacggtattcagtttctaaatctgtctgatcttcaaagaaccatacaatcttgcttaatatgccactattttcccaccatgataattgtaaccttgagttttgggatggtgtgtcatgagcatatacgtattttctaatgtatggtaggacacctgccagtaaagcgaaacagactataattcttattgttgcttttacccatatgttggagggaaccgcggaaataaaattcttgaaagtcccatcaccatcagtggttgcatgttttcgttttgaatgtgataccttatcgttactgcaattgagccccctttctcgccgtatttgatcctttaggaaagatatggtgtctgtttgtctctgtaatcttcttctaaactcttccagaatggctttttgatcgattcccgttaccagaggtgatcctgggtcagatgttctggagctattttgattatcttccacttgtctagctttctgtaagtcgctgaaccgctgttgtatggaagcatacttttcttgataagtttcgagccttattttcaattcgcttacttgtcgttcattttcctgaaggaggctttgtttcgcagttagttctcttttcaattcctccacctgcacctctaaggcctttcctatattattcctgcttaacagcttgataggtgattcagtaagcttcttcctaggtgtcgaaattccagccccctctgtattcttgttcttgttctcaaccagaaatttggaaggtgaattcaaattcatgcttacgataaaatcacttggaatagaatctacaccaatgaacgcgttttctaagatttccctgagggggtgattaaccaaattgaagaagatatcgtcaaattcttctttgtgtattttaaagaaggtttttgtattagaaaacgtgcgaaacaaatctttattgatttctgaaaacaatggcaatcgaagctcataggaaccacttttctgtgccttttgaaagatattctcaattatctcgattagctttggcaaatctttaccatatataaagtctccactgatgggtttgtcaatttggccccatgcgtactcaaaaatagcatcaaacgcaccgttactcatacttacgttgtcaaagacagaattgtttgtaaagctttctttcttaaccttggagccgccaaaaaaaatactccactaaggccagtagcaacaacacgttttcttggatgatgcgttttcttgaacaaacagtaccgactaggactgtttcaatgaagttgtgtacggtctggtagtatatctatattccgtgatgcctttgtggaggacgttgagatgagactgagtcgtacaccatgttattcctgtttacggttaattgcgcgtcgcgctttctctagcaaatatctcggttcgaagtaaagcaggtccttcatgtaatggtaacctaaggcaaagggtttgtcatatacccgtgaaggcatttacacaagcgcacttctagtcatatgcagttcatgcatattaagtgagtgttataacgcaagagttatatttgaaatagggttgttaaagaagggagaacccattcaccacattatctttgcgagtgtaaaactagataacttaaatttttaggagagattttgccacttggcagcaaataccaaatagcagtactgttccggtagataaaggcaaagagttagaggtgtgctttacgaacagcgctggaagggaaaggaaacaaaaaagacaaaaagacagctgtattgttggcgccatgaataatgctgcaaatacagggacgaccaatgagtcaaacgtgagcgatgctccccgtattgagcctttaccaagcttgaatgatgatgacattgaaaaaatcttacaaccgaacgatatctttacgaccgatcgtaccgatgcaagtactacatcttccacagccattgaagatattattaacccctcattggatccgcagtcagcagcatcgccggttccttcttcctcttttttccatgactcaaggaaaccttccaccagtacacatttagtaaggagaggtactccattgggaatttaccaaaccaatctatacggtcacaatagcagagaaaatactaatcctaatagtacattattatcttctaagttactcgcgcatccaccagttccttatgggcaaaatcccgatttactacaacatgctgtgtacagggcacagccgtcaagtggaaccactaacgcgcaaccgcgccaaaccacaagaagatatcaatcccataaatcacggcctgcatttgttaataaactatggagcatgttaaacgatgattctaatacgaaacttatacagtgggcggaggatggaaaatcttttattgtcacgaatagggaggaatttgtgcaccaaattttaccaaaatattttaaacattccaatttcgcttcctttgtaagacaattgaacatgtatggatggcataaagttcaagatgtcaagtcaggatcaattcaaagtagttcagatgataagtggcaatttgaaaatgaaaacttcattagaggtagagaagatttgctggaaaaaataatcaggcagaaaggttcctccaataaccataatagccctagtggtaacggtaatccagcgaatggtagcaacatccctctggacaatgccgcaggaagtaataatagcaataataacatcagtagtagtaattcattttttaacaatggtcatttattgcagggtaaaacactaagattaatgaacgaagcgaatcttggagataagaatgatgtcaccgcgattttgggggaattagagcaaataaaatataaccagattgcaatttccaaagatttactaagaataaacaaagataatgagttattatggcaagagaatatgatggccagggaaagacatagaacccaacagcaagccttggaaaaaatgttcagattcttgacatctatagtcccacacttagatcccaaaatgattatggacgggctgggagatccgaaagttaataatgaaaagctaaacagtgcgaataacattgggttaaatcgcgacaacacaggcactatagatgaactaaaatccaacgattctttcataaacgatgatcgtaattctttcaccaatgctacaaccaacgcccgtaataacatgagtcccaacaatgatgacaatagtattgacaccgctagcactaataccaccaacagaaagaaaaatatagatgaaaacatcaaaaataacaacgacataattaatgacattatatttaataccaaccttgccaacaatctcagcaattacaattccaacaataatgctggctcgccaataaggccctataaacaaagatatcttttgaaaaatagagccaattcctcgacatcgagtgagaatccaagcctaacgccctttgatatcgaatctaataatgaccgcaaaatttcagaaattccttttgatgacgaagaagaagaagaaacggattttaggccttttacctcgcgagatcctaataaccaaacgagtgaaaacacttttgatccaaacagatttacgatgctctctgatgatgatttaaaaaaagattctcataccaatgacaataaacacaacgaaagtgatcttttttgggacaacgtacatagaaatatagacgaacaagatgcaagactccagaacttggaaaatatggttcacatactttctcctggatatcctaataagtcgttcaacaacaaaacttcctcgacaaacactaattccaatatggaaagtgctgtcaacgttaatagccctggtttcaacttacaggattatttaactggagagtctaattcccccaattctgttcattctgttccctccaatggcagcggctccacaccgttgcccatgccaaatgataatgacaccgagcacgcaagtacaagtgtcaatcaaggcgaaaatggaagcggattaacgcccttcctcacggtagatgatcacacactaaacgacaataacactagtgagggaagtacaagggtgtcccccgatataaagttcagcgccactgaaaacactaaagtgagtgataacctgccaagctttaatgaccacagttattccacccaggccgacacggcgcccgagaacgctaagaaaagatttgtggaggaaataccggaaccggctatagtcgaaatacaggacccgacagagtacaacgatcaccgcctgcccaaacgagctaagaaatagtacacagggcaaggtcattaaatagcgtatataatcatttaatatagtatgttctcgaagctgatcgcgtaaggcgcagagcgaactaaaaaaaataccggcacccatgcacctcacaccgccgcacgcgagtgaggttgaactgcacccggaaaatgccaagtagatgagtcgtgaagagttctcgttattcgagctagtgagagcctgagaagggcttgccgagtgaactggtgtcacattggccgttttaacgcaagttggcgtacttatattgactgttggatgaaagggtaatcaagagaaacggaaacggcctcctcatcgttaagctcatcagtattcatttctcccctttctgctccatcgcgtgctcgagactatattcttcagattatcaagcagaaacagaattcgcatattacataactttcacaggttgaagtataaaccgctacagtacacaacctcggatagaatatagggaagaggccaattccgtgaaaacgatttaatattctttacagttacaaaaagtattacctattatcctcttttcggtgtcattgacaaacctcttagcgacagaaactccctagcaaaagagtaaatccataggaacaacaaaagaagacaaattatcataatataattgggagtgatagacgacgattcatgctataccgtaggtttttgatacaagtctaacagttatactatttttaaaaacaaaaaaataacagaaaaatctacgacaatggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattagcatatagatgaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtgacatttgggacattctctatcagatctcggaagagtgggatcggaaccaatatcttgcaccactcccgcagtttcaccaatgttggtaatcaattcatgcctgtagaccaatggactgcccgcttcttctacatacgagcatgttctgcattcaaataacaaccggttattttctttatcctcacgagggtacaacatattgttgcagtcacgacaaaatctaaacgtagtcatagcagttttaaggggagtttaacttgctcttttggctagattttgtaactttcgttctacctagaatctgctcttgttccatttgacttactctttaacgctattcaccaaaacaaaatttttcaacttacccgccctatgtcttgaagtccaataaaacaactcaaactaatggcaaacaagaactcggtaagttctggaaggaacaggacaagcagcccgtcagcagcaaacacagtcaattaaataagcgcccagtatgtccttacgtatactagcgaagagatcttcttctatctggatgaaaacgcgcgttacaccagcgctaatttctcctattactatcacaacccgtttcaattctacgactacaacagcaccatcacataaggatgatgtaaggccagttgatcctaaaatttctaaaattgtacaggacatttcacaattgactcttttggaaacttccagtttaatcaacgagctgaaaaccgtattgaacattccagaaatttccatgcctatgggcggattcatggcaggcgctgcaggcgcaggtgctggtaatgtacctagctccactggtgaagctggtagtggtgctgaagaagaagctaagcctgaggcaaagaccgtgtttacggtgaagttggactcgttcgacacgaagactaaggctaaagtcatcaaggaagtcaagggattattggggctttcattagttgaagctaagaaattcgttgaagctgcaccaaaggtcttgaaagaaaatgtcgccaaggatgatgctgaaaagattaagaaaaccttggaagacttaggagctaaggtcagtttagaatgattttaaaactgtagcaatctaccaatcgtgttaatcaaaatagtctgttttctcttcgagaaaataaggaatatatcatgtaaatatgtttaactctttattcttctttcgtcctgccttttatatattttgccacatcgcttcttgcaagtagatgtataaaaatgattgatttccttattattttctatagtatcttcaacttcattatggcattcgttttcgtgttataagtatttcagacgggctaatctatcacttcataaatctacttttccaacttacaaaagcggttgcttttcttcgaaatataaagcccaccaaccataagaataaagaacaagagcaggagcgaaacgaaagagaagataaagattgtacctttttgctcctgatttttttttgattacgctacggttagttgagagaatgtccactgctgtgactttttttggccagcatgtcttgaacagagtttcgttcttaagatgttcgaaagagttcatcaaaaaatcattgaaccatgactctaccgtttttatcccatttatcgaaggggaagccctcatttcgcccgaaaatggtgacctagttcagctttctaattctgtaaagtcttacaagaatattttgtcagcaatagttcctttatacactactttattgaacacaactcgctcaagaagcgatgaatcaggcatcaatgtaacatttttaggtctcctggaaggcacagattctgcatttaattttgaatggtctaatatttcttacaaaggaacaccatattttggattagatatccgtgttactgagagcacactcttcaagaaagtcgactttgagcctattttttcctatccgaaggtgaccagagatcacattttcaaacaaacaaatgaggatgcttcactttattcacaaggtaagatgtatctggattggctagcaaagtacaaattctgtcccggttgtgggtctccgttattcccagtagaggcaggaactaagcttcagtgttctaatgaaaatcggaatgtatactgtaatgtgagagatgcaagaattaataacgtttgcttcccaagaactgatccaacggtcattatagccttgaccaattcggattactctaagtgttgtctggcaagatcaaaaaaaaggtacggtgattttgtattgtattcaacaatagcaggttttatggagccatcagaaaccatagaggaggcttgtatcagagaaatatgggaggaaacaggcatttcatgcaaaaatattgatatagtccggtcacagccctggccttacccttgcagtttgatgattggctgtttaggcatagttcaattcaattccaaaaatgaggttatcaacctgaatcatgacgacgaattattggatgctcaatggtttgatacaactgaaatcattcaagctttggataagtacgccggcgggtatcgtgttccattcaaaaatgatatcaatttacctggaagtactaccattgccttccaattaatcaatcatgtttgcgagaactataaaaacttacgtaagacctcatcgagccatctatagtttttaatataataaacattgataaataggcgtgcttcagcatatggatatttttcactcagttacccgaagaaaacagaggtgcgtcataatgcaaatgctaaatgaatgaatataggatgttagattgctggtacaagcaattttgaaacaaaaatcattacgaacagaagaaagtggagctgaagagcgtatatagttgttcatagctgtaaaataatttctaaattactatttagaacctttttgatatccagcatcgctcattagagattaatttaccaaaacggaataaaccaaaaaaataagaatagtgaacacacaagagaagcgcaaaagagtaaagagctaaaatgaggtcaggcgatgcagagattaaaggaattaagcccaaagttattgaggaatattctttatctcagggaagtggtccttccaacgattcatggaaaagtttaatgtcgtccgcgaaggacactcctttgcagtatgatcacatgaatcgcgaaagtctaaaaaaatacttcaatccgaatgcacaactcattgaagatcctttggataaaccgattcagtatagagtgtgcgaaaaatgtgggaaacccttagctttgacagcaattgtagaccacttagaaaaccattgtgcgggagcatctggaaaaagtagcacagatccaagagatgagagtactagggaaacgatacgaaatggagtagaatcaactgggagaaataataacgacgatgacaatagcaatgataataacaatgatgatgatgatgatgacgataacgacgacaacgaagatgatgatgacgctgatgatgacgacgataattccaatggtgccaattacaagaagaatgactcttcttttaaccctttgaaaagatccacatctatggaatctgcgaacacaccaaatatggacacgaaaagatcgaaaactgggactcctcaaaccttcagctcttccataaaaaaacaaaagaaagtcaaacaaagaaacccaactgaaaagcatttaattgatttcaacaaacagtgtggtgtagagttgccggaaggtggttactgtgcacgttcgctgacatgtaagtcccattcaatgggtgcaaagagggctgtctctggtcgttccaagccctacgacgtcttgctagcagattatcatagagaacatcaaacaaaaattggtgcagctgctgagaaacgtgctaagcaacaagaattacaaaaattacaaaagcagatacaaaaagagcagaaaaaacatactcagcaacagaaacaaggtcaaaggtctaagcaaagaaatgtgaatggtgggaaatcagccaaaaatggtggtaagagtactgtacacaatggtaacaatatcaatgagataggacacgttaacctaactcctgaagaggaaacaacacaggttctaaatggggtatcccgatctttcccactgccactagagtcaacggtactatcgtcagttagatacaggactaaatattttagaatgagggaaatgtttgcttcctccttttctgtgaaaccaggatatacatctccaggttacggtgcgatccattctcgtgtaggatgcttggatttggatagaacaacagattacaaatttcgtgttaggactccacagccaattaatcacctcacaaaccaaaacctcaatccgaaacaaatacaaagactacaacaacagagagctctacaggctcagcttctttctcaacaacagcaacagcagcaacagcagcagcaacatcactcaccccaagcgcaggcccaggccagtacccaacaacctactcaaggtatggtgcccaatcatttccccggcggggcaacgaattcatcatttaatgccaatgtgtcgagcaagcaaattcagcagcagcagcagcagcagcagcacaagtctcaagacacaggtctcacgccgctggagatacaatcacaacaacaaaaactacgacaacaacaactacaacaacagaagtttgaagctgctgcttcatatttagccaacgctaccaaattaatgcaagaatcaaatcaagatagccatttatctggcacccacaacaataatagtagtaaaaacggtaacaataacctcatgacgatgaaagcctccataagctctcccaatactagcgtaaatagtatccaatctccccctagtgtcaacagcgtcaatggctccgggcaaggtgtatctaccggtattaatgtctctggcaataacgggagaattgaagtaggtattggaaattctgtgaacccctacaatggcagaataaattaattgaatcatgcacgttatccagcatgttcacgaagtgagtaataaaaaattattcgccgaagtaacatgtacacgtctatgtttgtggacaagttacgctatttgcatttagagatttcttctccaatgtaaattattttttcttcggggggtatacattatttatttaagtagacattatatttcttcataagggtaggagagagcgaatacaaatgcccagtaaattccccataagtagttcttaaaatataataccataaaagtggccataaataggaagggccatggattattgggtagaatttttataaatgccatatgcaaaataaaattagagaatgaaataccgaatatttcccaaggataatactttttttctttccatatgactttctcgacgttttcttcaaatgactgagtcattgcttccctagaaaagtatttcttgactcttagcgggccattcctctcaaagttcacagaaccgttctgcaagatctttctgctttcatcaattgcagtagcccattgaatagggacggcaggttttagccacccagtggcagaactttcattttcaccagcaacgtaagatttgatagtctccaaaggacctccattgtttactgctagtacaggcttacctaatttcatggcttctaaaggaacaataccaaagtgctcatatgctggtgtatacaataacatttcggttctttcgagcagtaattctttcagagatgatgaaatggaagttaaaaatataattttactattattggttttgaatgactctaaatcggagacgcgctttatttcttggtagtatatggttgtatgggataattcgtattcatcggccagagactgtagttccttcaagtactccacattttctgcaaccctctcgtcataaccaccgcaaataactaacttaacgttgtcattgatttgatcttcagataacgcaaaagcctttatagccagcgcaacatccttttttttctcaaaacgatttatacttaggtaaaatctatcgccttcgttaaacactgttttgaaaaatttcttgtcaatatcttcaatttcgattgttgataaatccacgcatggataaatgacgtctggatcattggataaatacttgaacgtttggtggaacgtattcttagtgaaatttgaatttaccacaacagtatcggcagcactcacggaaaactgttctattaagtcaaatggtagtctgtatattttcttcaatagcccagctctttgagccaataattggtcggggaaatgacaataaaacatcaaagtggcagaactaaagatatgcagaagcggaatacatgtagacagttgatcaatgataattaattggtacgcattcacttttttctgtaggatcaattgaataactaaataaagctgtctaattgttgcgaaaacaataaaaaaacgacccaaaaagtttgtcggtaaaaaatcaccataaacttcgacttttaattggccgtttttaacttcttcgaaacaatgtgatttatcacagtgactagtatagatgattacactatgtccttgttgctgtagacctaatgctgcatcgacgactaacctttcagcgcccccaatacctaggtctggatgaataaaagcaatcgttcttttatccttttcaatcatttttgcttgtctaatcgactcttttttatctgtctttactactgtatctatttcgtgacttcttaaatggcgaacgtaatcttttgatgttaaaatgaatacatcatttattttgttgttcgcgcgttcatctagccaggcacttgtttataaaaaaagaagctatacgcaaggctctcgatctataaattgtatctgtgattgtgaccctttcgtatatatgttataatatttacaagaatatacatttatcatgataatctctggtgctttttgatgatctttggaagagctttagcccaagattttgttttactgtcagttagcataaatacgcggccgccctgtttcattctagcagttctgcccactcggtgtatcaggtctattgacgttttgggtacatcgtagagaacaacattccgtacacctttgaaattgagccctcttgccatgaggtcggtggttacgagtacatgcaaagacttgttactgggtgcggtaccattagaatttgtgtttttcaatttgccgatgacgatgttggaatcaggaatttcaaatttcttcaaggaagtgggaggtgaagtactctgagcaaccacctccgaaagtggtcgcggtggtgataaaaagggcataattttctcggatctttcttcaaatgtatcttcaccagttaaaccgatggcattatgaccgaatttcttattcaataggttaacaatttcaggaacattctttttttcgttaacaaagataatgcatcttttctcgaaccctggttccgtgtcatcatttgaaatagcatataaagtttgtgccaatgctttgatcttggatcccttgaaaggacttaaggcagaatttataactttaaagtccaaagcgaatggtaacttatgcagtctgggtgtcattataggaaccactgtaggaaatagtctttgcattgttttattaaactcttgaggaatagtagcggaacagaaaataaggtgattaatgttaggaattctctttattgcggagtgcgtttcttcaagccatgacctatctagaagtgtgtcagcttcatctagtactacgaaacccactttggacaagactttatcaggtctagttatcattcttatggagaacaggttcagtagttttcccggagtagtgactaaaatatctattctatttttaatgttctctaataaatcacgatatgatgtggccttgtcccacttgaaagagtttaagcctaacaaggttttcgtcttggaaacagtttcgtatacttggtcaaccaattcatgcgtaggcaccagtatgatggaccgaatcagaacgttttttcttaatgtttcccataattcgggagtttccaactcctgtcttttcaaatagtctattaaaggtatcaagtaggccatggtcttacctgaacctgtctcagcggcaatcgcatgtatttgtaactttggatccattaaatttttggatattctcttaatggccactgtttgaatgggactcggtattatattttcactggtttttttcctactatcttgtagcttcagggactctttggaaatgatttctttcacagcgtctctgacaggtggaagtataagcaattggtcgaaattcgatattttttgaatgagtttattcgtactgtccatattcatctcgacgtcttttttcaatccaccatactctccaaagttgaatgcttggtcagggtcattctttttgttaccttttttgcctttggccttctgttttcggtttttattactactgcctgtaggcactgaagctaatggagagtttcctttatgctttgttcttgggcctcccgcataagaacgcactcctatcttgagaagcacggggaaagaccactgtggtgaaattactggcttgaaaaaaagcgacatttgtcttattatactttaatctgatctgaagaagtatttctactcatcactaatatctattccgctattattatagttgtaatttatgattccgtggtaagtgatttgaacttttgcttcctttcgaaaatttcaagaatatggtttggttgtgctgtgcaagagcggttgtattgcgaaatagaacccatcgagaaaagaaaatgaaaaagacggcattaaagactagctctgttttaagacaaatatttacaggccagagaataaagagatactcgtatgtatgaattgtagccccttacacacatatgtatatatatcgatgtgaacatagcatttattaacagttctgctcagtacaaatggtagtagtactagtgatgaggttactccgacaccgttaacagcggtagtaaagagaaggccgagtaaacataaggtcgttatgctcttaggttactgtggcagcggatactatggaatgcaatacaacccaccacacaagacgattgaaggtgagattctcaccaagctcttcgacgtaggagccatttccgaagaaaattcattggcaccgaagaaaaattcctttatggcagcggcaagaacagacaagggtgtacacgctatgttgaatctactgtcgctaaagatcacattgcgagaggacacagtagcgaagttaaacgccgcactaccgcccgaaatacgcgtgtggggtatccagcctgtcaataaaaagtttaatgctagatccgcgtgcgattctcgatggtaccaataccttatcccagaatttatactcattggtccaccccggagttctcttttgcatcgaaacgtggggggatgctaccgcgaagacggctcgcaagaggtgtgggatacgttcctggaacagacgcgtgggagatttagcggggatgagctgtgccgtttgcaggacactgcacagaaactaagcgagagcgatcctttggtacaagactacgtggggctattgagcggtacccttagcggctactgcttgtcgccctcgaagctggacgcgtttgaggcagccatgcaggagtacgtgggaacgcataattttcacaactttaccacaggaaagctttggggggatcctagtgctcagcgccatatcaaaaaggttgtagtgtcgcaggcctcaccgggatggatatgtgtgcggatccacgggcagtcgtttatgttgcatcagattcgacgaatggtagcgcttgccgtacttgcagcccgttgccaattgccgcctaatattgtacgtaactattttaacgccgggcctaggaaatacattccgagggcgcccgcacaaggcctattattagagggacctgtgtttgacgggtataacactaagttgcgcaatttgctgtattgcgaaatccgcccggacgatatcactcttgagcgcatgtgccgtttccgagaacgccagatctgtactgcgatcgcacacgaggagacacagcgtcacgtgttttgccattttgtacgacaaatgaaccgcctggccacgcctctaatctagccgcccaatgtcgcgggttgacccgcgacattgggcgggcaatactctcatcttattggctattcaacttagacaagcgccagttgcgcgcacaaatttggtcatgaccgctccaccggcatgcgtgtcgtcatcccgcatcattcgggacattttggccttttccgcagtgcgtagttgacgtggggagaaagctagtgggctgtcgcatatggttggttttaggtggcgaaagtttcgccgcgatagcaatcatgtcctcgaccttaatctcaatggaatgggtcatgctcggtaagtgagtctcgctgtatataagtatatatgtaatcgcctagttcgatagatacaaggaggtcttgagtatgtagataaacgaaaagaagataacaaaaggaaaatctcagcctctccccttcctcttagacaatgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtgctttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatgaaccggttagttctcatttataatgtataatatacccgaatcttatttatttacctttcctattttttgacgaccagtaaatactaatacataattaggaacaaaagttaaataaaaaaaaaaataataatttaacgcatccaattaacgtgtccttttttcatcattaatttatctactatttcgatttaaattccatatacaataaatcctagatacattcccgaaagcatcttttagcgaaacatcttccttgagctgctagcagtgggcttagtccacctgttagttactcttggtataccactaggtcttttcgaggcaggaacatgggtctttcttactcttccgttatttgaaattcctgccgaaggaacgggccttctaccagattgcacaccgtaccttggatttaagccttgatttggtggctttgctggtgcagcatccttttcacccttcctattttctaatttttgtctcaaatccaagatctccttctttttcaacgctatcacgttgtgtaaagtactcccatcttcatcatttgtgtttacattttcattgtgcagtctatcattaattagctttaaataggtttgatcgctcatcaatttatgaatataaccagcttgagaatgaatgttgatccatgaatctaaaatggaattcgtagatttacatacctcatgtacttgattaacgtatactggcaagttattttttaatgcggccgtaacattttttatcattgctgttattttatctaacgattctgattctttgagtaaggattgcgttgtgattgaattaaacgatcttatagaattgctgttagccgaaatattatcgcttgctccacctcctgtgctttttggaaatttattggtcgtgttattgaggttagatctcatctcattgaaaatctgtggaatcagtttgtctatagtcgaatcatctaattggctttgctcactcatattgaagacttgttcaagtttcaaattatcttctttagtaatacttgagtcaccagtccagattacttagcctatctttctttatcgcgtttgattttggcgtttgtttgtaattattattcttttttccttcgtttcgctgtgaaactaacttgcgctgaggtccaaaaacctctcatctaagaataaaggaaaatacatattatcctgggtctaaaaggctaaaagaactcaccgtcaagaggaagggctcagaaagtatgggtgagtcaattgaaacaatttgtaaaagccttgtcagggctttccaagaggagaaggatgattttgtctcacttgtaacaatcattgatatgtacaacgagcaggtgaactctggaaagtctataaaagaaaaggaacgttatttggatgccctattgaaaatacttaaggataatccagttaccttaaaggaaattggctgggatctgccaaagggtttattgcagtttttctcacgcaaaaacatcaatgtcaatatacatctagtttttagtccccttgtttctagtgtgatggaatgcttcaatgagctagccatcaatggaaatccgaaagaatgcttgttgaccgcttgcgaattggtgtcaacactccatatagtcttaactgaaactggcgactccgatgaagagaatgaagatttaaatgactccaatagaaatgatgcgtcaaacattactgatgagctgtcagttatcactccggagattgggcactatatggccaaaaatacagtagaattcattccaaatttgaaaatttacgttctctttgaatttatgagtttattgttgaaacgtgtggacactttatatccatctaaatttctagccatggtaacttctgcaattattaagtatgtaacaaccaacgttcaggctatggatgatccacactttattttgcgcatagtgtacaatttttgtactaattactctccagctcaaccatctgctagtctgaccgatggtattagtacaaacgatcttgaaaaaattcatgatgatgaatctgccttacagaaaaaactactggctaatctgagcgtattcgtgattagcaactgcctaaaaaatcatccaggtaatattgacaagatatatttcaaaacattgatgcataaaaaaacagatgaaaatgaaatcgatgcttcagttttacagatatgccaccaatactacgagtatgtcacatcattggatgtccacatgaaagaacttttagaaaagtgcctggtagaatcaagaagcatctataactctcttctcatgaacccggccgcttccacgcccgaattcaaagaagaaattaaccaactagtatatgaggtatcttacgcatatcaaatcaagaaactagctgacgaaaagaacttagagctggaccaatatggagttgtgattctatctgcaatacattattctaaaaatggtactcacttattgccgcaaattgatatccaaagcgcaatttacctctatctacggtgtacgacagcttctttattttcagaaatatacgaaaataagtttttggaaagttcagtacgctactggctatgggtatccacaaccgagacttccacagagaaaataaagtgtgccttacaagaacttccagggcacattaccacggcctttttgcagatgttactgatgaaaacttgcaatgaatctaataacgacactaagttgaccgaaattactcttctgaggaggttactctatctcatgcccgaaagcacatcttttacgttcatctttgaaactctactacattgtccatatataactgcaaagattgctgttcttgacattctaagagatatgatgattagatctcctgaggctgctaatcgtgacgaaactgtcggtttaatcgaacaacagaatcctgggaataccgctaatagtgtaccgataatgccaactctacctccaagaccttacatcactattaatgaagatcgcatggcttccattcatagcattgctttaatatgtttttctgccgccaagcaaaagaaaagaacgcaaggtgatttactcttggtactaacatatatgaaattttttgttagtttaaggaacaaatgggatttgggtctgttaacactcatcaataaagaaatctccgaatcatttcaaggagaaggtgagcctgaattagcattcatcaacatttccaataatactctgggagaatatatagaagagatgaacatacgctcgtaaactacatagtaaattagttgctcttctcttttgttcccgagtaaatcgaattattctattaaagggaaacactatgttttgagtcatccaaactttcatttttttcagatttcatcgcccgatcgtcaaggaataaaaagggaagggatgggatacttgcattggaacccagaaagtacgtaaaagatgaagatcgtgagagattggtcaatggataaatagttctgtaattatgtctaagtatcaaattaattgcataagataccggcactttctcaggacatctaatatctcgcagatccctgatttcacgaaatactgcattggtcccgtaaatgaagaattggcaccttacatcatggaaaccatgaaggcatacccttcaaattccgaatatatcaatccgcagcattactatcataatagaacggtattagtagaaaattacttaaaacgaagtccaaatccagtatcattaacgcagttagcgcaatattatgacgattctaccaagctgaccagaaccaagatcatcaattccgggaaatttgtaaaagaagaactggtaattaggatcgcgcataaattaaatcaattgcaacaacttccatttaatgttgtgaacaacttccattttgttcaagtttatgagtcatattacaatatttttgaaagctttagaaaatatccgactataagaactttagaggacgcttctcaatttgcagattttatcaaaaatatgctagaaggcttcaatactctaaacttaccacatttgataatgggggctttagaatgtacaattttggatctttatcctcgtgaaaaaatggaccaactactatctgatctgttaagagctcgaatatcaagaagattgattgtagaggaacacgtcagtatcacagccaactacactagtggtaaggaggaaaataccttggtattgggtgatatttttcaagaatgtagcgctaaaaaatatttattggaagccagtgaggaatctcaaaaatttatccaagatatgtactttaaagacattcccatgccagaatttattatcgaaggtgacactcaactaagcttttactttttgcctacacatttgaagtatttgttaggggagatccttcgaaatacttacgaagcaaccatgaaacactatattcgtaagggattagaaaagccggaaccaatcatagtaactgtagtaagtaacgatgaatcctatttgtttagaatttcagataaagctgggggcgtcctccatgatgatgaaaatctatggtcattcggtaaatcgaaagaaagggctcaagaatccctaaataattttcacaagttacctggtttacaaacagtatctatttatgacgaagtacattcccatactaaatataactccaaactgaagtcattgcagtcaataacattaaaaccgtacatgcacacgtcgctagaaccaatgagttatcctagcatcataaatgggcacatcaaatatgaaactcccctaattgaattgttaaagcggtcttttagatacaagcttgggattgggttagccatgtgtaaagtgtatgctgaatattggaacggcgacctttcattgcattcaatgcctggatatggtaccgatgttgtattaaaattaggcaacttgatgaagcatacgaagaaactacaattagataaagtgtgagctaaccatgcttacactatataccaaggaacaaatacatattcggaatattagtatggtgactacatttcccggattagtgtatgtatatacaaaaaggcacctccgggtagccggagtagaaagctggaaaaataaaaatgaaagcgaatggaatgtgtaagagaaaaaaaggaaagaactatcaagttgcagagttgatgacataaatagtagagtggaaaatcaacgaagatcgaattccaaagattatttttaggcagacagagactaaaagataaagcgtcatgtccacaccagctagaagaaggttgatgagagattttaaacgtatgaaggaagatgccccaccgggtgtatctgcttcaccattacctgataacgtcatggtatggaacgccatgattatcgggccagccgatactccatatgaagacggaacttttaggttattgttggagtttgatgaagaatatcccaataagccaccgcatgtcaaatttttgagtgaaatgtttcatcccaatgtctatgcaaatggtgaaatttgtttggatattttgcagaacagatggactccaacatatgatgtcgcatccatattgacatccattcaaagtttattcaacgatccaaatccagcttcgccagcaaacgttgaagctgcaacattattcaaagatcataaatcacagtacgtcaaaagagttaaggagacggtagagaaatcttgggaggatgatatggacgatatggacgatgatgatgatgatgatgacgacgacgacgacgacgaagcagactgagaaaaatcaaaagaatcttaatgatgaatgccgagccgatattatgaattcgattacctttttgttcaatcaaatatagggcttcatcgtgagtttctttctctatcgatccgtttgctttctattcctccatcttctactttataccgtaaagaaaatttaataatgatagaaacattgcatataaataatatactaaaaagaaacactgctctaccataaatttctttggagaaaataacgtgaaatgagaaataaggacaatttgttatcggttataactgccgatacccgtatcttttgtgtttgattcaaggaatacttatttagagtagaaagaatatatttacttagataacttaatgtataatatataaaaaaaatcaaaaaaacaggaaaaaaaaaaatcatgagtgagtggcacttttaactgcaagaatgaagagtgaccccatttttttttattctgatattacagtactcttctgtgcgggcagctccttcgttttttgttttgcactttcatccaaccacacatatatggaaacaaaaacgacgaatgaaattatagctttgctgaatggatctatgctcttccaagtaaaccttttatcatcaagatgaaacaccttgaccacgttttgcacatcagcaggtagtatatttgcgtttttgttattttgtaggagaaaccaattatattcgatgaatggaagtttcaagaattgggacctaactgacggagaagagtttgtcaggacaaattgagttcgaggtccaagaaagccaaatgacttgtagtaccacaactgaatgaaatcttgctttagatcattccagtttcctcgcattttctcatttatggcaaaatccaataaatctaagtcattaccacttaacttaggaaaattctgaagtaatatattcgtatctatcaactgattgttatgtgtcgaagacggattgaagaatttgttcataatgacaccaagctcgccgttgtttagacgctcagttaataaatgatcgcgtttcaaaccacttgtttcgtcttcatctagatctggtgcacttggctgcaagacgctaaatatctcggacatggtctgtgagaaggaaatggggttttctgtagatgtagtactgccattttgagctaaccgtattttctgcttcaaaagcagtgaagccggtggaattctttctaattttggttgataaaatctctttaccaaaagatttcctgcgactgctttaatcatgggaccgattctgaaggctctatgcgattttaatctgaagattttaacatttgacagtaccatctcaatcggaccttttaactgattttagcgagaacatgtgtatatatttcctctaagaaaagaaagggcctaaaaacctcgccccagtgcataataaaagtaaaaaaaaaaaaatcaaactttattgggataaaataaaaatcagaaaaacccttatatatgtatatgtagttaaatgaagccagtttttttcgtctggtttgtttcagcctatatgccctctttgctttcttgccatctgcggatcaatttccttatgatgcgtttgttttcttgccaaaacacttaatatgtcagtcaatgacacaacacctatcaatttacctgttctatactccttttcgaaatgtgctggagttggagatgcgggacaattacttggactttgaggtggtggcattgtggccgatggagactgtggttgagaaggtgagggaccactcaaatttatatttacatttattttattgtttgatgtatctgaagattttagaacaggagagttggccatcctggaagattgcgtgttcgaatggtatgacgacgcaagcgatggcaatgtcgttacgggtggagtacttggtgatggagatgaggatttttcggaagatgctgttggttgattgtcatttggttgtactatccataatctgtgagatttggtagcgaccaatttggcaaacgttcttgccagggaacttgttggatacacatggaaaataggaaatgagtccttaccggtctctaggccccttaaattcaaaataaccgagacaaaatgacgacatgtattgtgtaataaaggatattgtgaagttctggtgacgtgtttgacgtctgttactgaaatattaccaatcaagtttccctgcgggtcaactaccgcaatggaagagattctttcgacatacattttatgcagagccataattagatgctcgtcaccttggatggatatgacacgtgactgcttgaatgtaggtttatcacgggctgcatttagtacaccaatattcagctcctccagggaagagtccaagagaggcttcaagttgggaaatgatctcgcattctcccacagatacttaatcaatcgacgttgggaaagtatacctttaatctgtgtcatttccacgttcgtgatggcaacacgatgcacacctgagcctagtatgcctattaccgtcgataagttttccgtttcgggcaatttgtagaatggattcttaggtgtcaactttactatctcgcccacgggcacggacttaccattctggcagtctgaggttatcttgtcgttgctcaccttgatcctgtttaatacaagaagaaggtacgcattgagatcattatagtcgaatgttaaacaattcatgtctcccggaaaattctccacaggcaaagacgttagctggtgcttgaccagcgtgttgaatgcttcctctacggaaatagaacctctgatgaaaatcaatttgttctgttccaccaaatttgacagaggagtgtgttgccactcctgcctatgaacagataacagattctgtgaattcaaggtggacaaggagttgccattattgtttgagtattccgtgttatccagcgtggagagagaagatgaagatgacgatttcgaaatagatttatgtagtgattctgtgtcgcttttgtttgcttcagtgttcttgtctgtctgttcgctcaaactatttaaatctgtggaattcggtaattgaggtggggtagaaagcatttctacgatggacgtgtgtcttgtattttgaggcattgggtgggtcttgctgaaaagatgatgttctgaggtattcgtatcgctagcttgatacgcttttaacaaaagtaagcttttcgtttgcaggtttggttacttttctgtacgagatgatatcgctaagtttatagtcatctgtgaaatttctcaaaaacctcatggtttctccatcacccatttttcatttcatttgccgggcggaaaaaaaaaaggaaaaaaaaaaaaataaatgacacatggaaataagtcaaggattagcggatatgtagttccagtccgggttataccatcacgtgataataaatccaaatgagaatgagggtgtcatatctaatcattatgcacgtcaagattctccgtgactatggctcttttctgaagcatttttcgggcgcccggtggccaaaaactaactccgagcccgggcatgtcccggggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaagatgccaacttctggaactactattgaattgattgacgaccaatttccaaaggatgactctgccagcagtggcattgtcgacgaagtcgacttaacggaagctaatattttggctactggtttgaataagaaagcaccaagaattgtcaacggttttggttctttaatgggctccaaggaaatggtttccgtggaattcgacaagaagggaaacgaaaagaagtccaatttggatcgtctgctagaaaaggacaaccaagaaaaagaagaagctaaaactaaaattcacatctccgaacaaccatggactttgaataactggcaccaacatttgaactggttgaacatggttcttgtttgtggtatgccaatgattggttggtactttgctctctctggtaaagtgcctttgcatttaaacgttttccttttctccgttttctactacgctgtcggtggtgtttctattactgccggttaccatagattatggtctcacagatcttactccgctcactggccattgagattattctacgctatcttcggttgtgcttccgttgaagggtccgctaaatggtggggccactctcacagaattcaccatcgttacactgataccttgagagatccttatgacgctcgtagaggtctatggtactcccacatgggatggatgcttttgaagccaaatccaaaatacaaggctagagctgatattaccgatatgactgatgattggaccattagattccaacacagacactacatcttgttgatgttgttaaccgctttcgtcattccaactcttatctgtggttactttttcaacgactatatgggtggtttgatctatgccggttttattcgtgtctttgtcattcaacaagctaccttttgcattaactccttggctcattacatcggtacccaaccattcgatgacagaagaacccctcgtgacaactggattactgccattgttactttcggtgaaggttaccataacttccaccacgaattcccaactgattacagaaacgctattaagtggtaccaatacgacccaactaaggttatcatctatttgacttctttagttggtctagcatacgacttgaagaaattctctcaaaatgctattgaagaagccttgattcaacaagaacaaaagaagatcaataaaaagaaggctaagattaactggggtccagttttgactgatttgccaatgtgggacaaacaaaccttcttggctaagtctaaggaaaacaagggtttggttatcatttctggtattgttcacgacgtatctggttatatctctgaacatccaggtggtgaaactttaattaaaactgcattaggtaaggacgctaccaaggctttcagtggtggtgtctaccgtcactcaaatgccgctcaaaatgtcttggctgatatgagagtggctgttatcaaggaaagtaagaactctgctattagaatggctagtaagagaggtgaaatctacgaaactggtaagttcttttaagtatcacattacaataacaaaactgcaactaccataaaaaaaaattgaaaaatcataaaattaaaaaaaaaaaatacaattgaattttttttttctatgattacgttttgacatttttcctttttttttctcttattacgatttaccttttttatttatttttttcattttagtattttattcttcgttatttatgtatagaaattttcattttcatttagattcagatttggttatcttttttcattatatatcttttgcactaagtttcaacttaagttctattttttatttttttctgggccctggagcaatagatatgggatggcttactgcatctcttcaaaatttcacagtcatgctcacccttaagttctcaaccttttagtttttttttttttttttattttgtatggcatactaactatacaaatatttatatgtacatttatacagtaacctattatttaccgatattcaccggtattttactttaatagatgctggtaataacgaaaaaaattgataactcccaccgacaattgagaaaaaaagcaaaaaaggaaaaaagggaagcacgaattaatacattctgtgtatttatcttttttatcttcagttttcctccaatctatgggcggccattaagtatgtctattattcttggcccttcagtcttctttggatttcaatgtcttgttggattagaagtcatcaccactttcagcaatcaaagccatgatcattctgtacaagtagaagaagaacatcaataagtggaaacctaactttaggaaactctcccttttatgtttgcctaaagttctgaatatttcggtagcatccaaaagttgaactttattgtagatcttgtttagattgtaagctagaactggtaagttcaataaaaatacaaaccagtaaccgttcagtaagaatagtaatgacaaagcaccatgcaaggcggcttcaggggtaattaacttgttaactttagaacataattcaattggattgatatagtcagcttctaaatcagcgtatagtattgtgaaatgcacttggccaaacaaattgatacagttgacaacaacagcaaggataaataaccaagcacccatttttctttttattcttaatttttttactttactttaattgcagttcaaaggtaaatgtctttgttaagtaggcagtgagacataataatatgagaaaaatccaggtctctccttcgtattaaggaatacatgatctagctatcactcttaaatctttctccttccttgttttttctccgaaatgaagaaaaaaaattttcttcacggaactaacgtgaaaaaaaactttcaaaaaaatactccgatacggggagtcgaaccccggtctccacggtgaaagcgtgatgtgatagccgttacactatatcggaaacaaattaactgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattagtatgtagaaatatagattccattttgaggattcctatatcctcgaggagaacttctagtatattaggtatacctaatattatagcctttatcaacaatggaatcccaacaattatctcaaaattcccccaattctcaacatccgactgccatgcaatgtgcttttctggatctcactcatgatcataatggccctgtaaaaggctcgtactgttattatcatatcttcaattacgtattatttcggaggctgtacctattagtgaaataacgcctctaaaaatgaaaagaagaaaaagaatatgaaaggggttctgaattgctaaaatatttcgtcaaagctcaattagtatcaagatcaagtcgtaattcgaatcagcataacaacctccaaaaccatataataaccttacacaagacaagatatcaattcaacatgcaaaccccttcagaaaataccaacgccaagtcggattctctcgacgaacccggtgcatatttaatcgaggaaaatgtggctcttcctaaggacatattccattcgtacttgagttattggatatatgaagcagctcactgtacaccggtcatgcttttgtctctagtaattggggttttaatctcaataattattctttttcatgataacgaaaattgcgttggggtttctgtagggtttctcctcatattctctggcattttagtgatagttctaatactcaggtttggaccacagatcagtgatgaagatttcaaatgtaagctactgatggaaattatcacacggaaacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaaggatctacttctcgattgacgacactagtaggtgtcaaatttagtgtcatttatgattttttgtaataggatataaatatatacggcgctccaaataatgcagttgccccaaaaacaccacggaacctcatctgttctcgtactttgttgtgacaaagtagctcactgccttattaccacattttcattatacatcacttcgcaaaatgcaatattgaaaatgcctctagagatgaaaaacaatcgtgaaaagggtcctgcgttattaaaacatttgatcagtatgcaatggcacagagacaatcaggaatactatagtcatagacgatacaaggtatatattggtcatgcagacccctctagaaagtaccgacgtcaagttagatacactcaacgaacctagtgcacatttaattgagaaaaatgtggctcttcctaaggacatattccgttcgtacttgagttattggatctatgaaatcgctcgctatacaccagtcatgattttgtccctggtaataggggttttggttttattaattatattttttaatgacaacgaagcttgtgttttcaattctgcatactacgcttatctttctcttgtagtattgttaataatattaggtgatggtaatccaaagctagtcagtcgtcgaaattttaggaccgagcttttagtggatgtcatcacacgtaaaccggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatacgtaaagcgaacataaactagagtatgatatataatcagcactaactggcccgaaaacggccgaaggaagcctcgaaaagtcgattcgtgttggacccatttgctgaacgaagtggttcattgcctacctattatggtagtagtcgtgataatcgtgtggttggttttgtcaacggtgcatttgcattttcatgacaataagccttgcgttttcgttctcgggatattactttccccccacttctttcgcctcgatagctcctataagcattctcagggcgtatgtcggtgatcgagatttccaagcaagcttttagtggaaatcatcgcgcgcaagccagcggtaaagggaaaagaacggaggacgattacatacaagatgaacgaataaataaattaataataaataataatagaaagtacagtagcattaaatattattaagtttaatgattaaaaattggttaattgtcaagaaaatctaaggtattaataaataaataatactatgacaacttgcagcgaaagcatcagccccaatgaaaattaatcagaattgaatttgagcgtatctatttgataacggtttacgtaactgttggaataaaaatcaactatcatctactaactagtgtttacgttactagtatataatcatatacggtgttagaagatgacgcaaatgatgagaaatagtcatcgttttcaatggaagctgaaatacaaggattgataattgttggaataaaaatcaactatcatctactaactagtatttacgttactaatatattatcatcaaaattcacccactcttcagttacttatcttatatattatataaaatatgaatcatactaagtggtggaagcgcggaatctcggatctaaactaattgttcaggcatttatacttttgggtagttcagctagggaaggccgggttttatctcatgttgttcgttttgttataaggttgtttcatatgtgttttatgaacggttgaagtattgtcatactgacgcttctgattttgagattcaacacttccaacaaacagtagctcgcgtggcgtaatggcaacgcgtctgacttctaatcagaagattatgggttcgacccccatcgtgagtgctttttttgaataagcttgaaattggtaagacatgccagcgtaccatagtatttcgctttactgaggtaacgacagcagatatcaaaaattcattttttcttacccagaacagagctcttcttccactaacgcttttagttaggaatgtatacattaacagtctatttttttttgaaacctttcttcactgagatacaacagatagataccaaccagtaagatttaagtaactcatggctgcgcagaatgcctttgaacaaaaaaagagggcaattttgaatgagatagactcaacccaaccagatttgtcaccaaaaggcactatagatgaactatgccttccaataattgatcttatcaacgcaagcgctgatatggtgacaacttcatcgtgttccggtagagtcagtgtattcttggaaggtactaagtcatataacggggaggtcaagataggtggtaagggacaaggcggtaaatggctttacgtcactcatgatcgtgagaaagttattggctggttagatgagttgaaatcaaaaagtgagttttcttttgaactatctggcaaggagataccaacagagaaagtaacggggagtatcagatatatactttataagtatgagcctttcatattgcacgttaaatgcagagactttcaagcagcatccaagttatacaacacagccatgtcttgtggtttcagagaaagtgggattggttcgaacaatctggtcgcaatcagaataaatatcaagctggacgtaccgctcggttatttagatgagacttcaggcactttgaaattttttgtaactccagaatacgtaagcgttctggattctttatcgttaagcaaattcgatgagaataccaggaaaatgcaagcactatatgatagaattgaaaaagaactcataaattgtgcgccggatgtaaattctaaggtcaatataacgccaatcgaaacaaaggaagagaggagagaacgaaagaaaagagaaggtatggagagacaacgtcaacttaagagcccacaaaatgtgctataagaaaaggggacataccaagaattactcagcctttatttttctttcttgtggctcttgcgttcatttttcgttgttatataatcttgttaatctttgacgggataaaagcgttattattttgtaatatacacattaaaacttattttttttcttaaatttatctgtatatgatgaaagatcaggtctagttaatgcacaaaaaggtttaacacatgaattaaaaaggaaaaagactagcttatcgtttctaaaagaaaatcttttaatcactgtccccatcgttattcattaatgcgtcgaacatattagctcttggagcttgagaaacttcttcgactttacgagcatttctttggttatttctgaaagaacctgttttcgtggaagcaaaactatctctttgggtgttttgcatgttccttctgttagaagaatatctgttgctgttcgattggttgtgattgttgaatctagaatttgatctctgactgttctttttctgacgtaattgttcttcttcttggtggatttgttgaattgtctttggtccggcgtctttcttagcgctgttccaatgcttaatttccctcaattccttcacgtctatcaacttgaactttattctgttcgatatggtgccaccgtcaatgatatgttgtaacaacataaatagattgtcgagtagtaccgaaccttcaagagttgcctgaggcgtaacaaatttatcatgttcaaattgttcacccacagtattcagtaattcaataacggactctaatgtctcctcggatggatcgttgtttagatctttcattaatctccggaagcactcaaacatcatcttaccagttaataagttcaaacaatataagtaccctatgaaacgtactaaacctaaccctcttctcttggcggcagccgcaatataatactcatcggacatcatttcaggttctagtggattaccatcttctcctgcaggcaacttatcagcccaacctttctcaaattcttcgtgacatcttgccactaaataatgcaacacaagctttggtccattctttccttcgttctctttatctttaatgtttgggtcaaggtctttgaccactttgccacataactgagcatacattgaagaccaatgaggttcatcacaagccttgtggaaaatttgttcaataactattttcaatgtttcgccatcatcttcccactttgattggtttgctatatccaaaatctcagaggagattgaatcaaacatttctaaagttaacttgtttaatagagacttcatttttcgttctacttcttccttgtcaaataattcagttttgccgtcaggagctaacttcttttctgtttttttaacccttgatttaggtatccatctattagcactcggaaccaacggggcgatttcttcctttggagcttgctcttctgccttttctgcagctttttcgcgatcttttctggaggtatatcctctattagatcttctgtcgtcacccattctctttgatcttcttttcgatgaaactcttgaactggaagtatggtccataccgcgcatagatggacttctgaaatcgcctccaaatctgccactatcttttggtttatttctggctatatgaggaggtataacaattttcgaggatacagcttcaacccacgcaggatcaggcctgaattttagtttatctttgaattgcagtaagaaggtagggccataagtgtacttaacgcttggtttcttgtatttgatatcaggcctttcaacattttccggataggcaaactcatatatgtcagaaattggttgagccttacctaaagtttcaagtagttgagatacagttggcatctcaatatcggaagtggaaggttctgtctccttcactgtgttctcctctgtggtgattacggaatttattgtttcgtcgtcacttttatttacagtttttccaccagtcgtatccgaaatttcagtagtatcatcatctttaacaagctcatcaacatcctgagaactgctctcattctcgggttcgttaaaagtcacggatttagttacacttccagttacatgttgtggagttttgacacttgcccctgattttccatcaatcacaacttcattagcttctcccgttggtttcggcgcttccttaataggttcagattcaataaccgagttgggcttagttgtatcagtattatcatgatttgaagtttcttgcttcttctcagtttcggagattaaaccgtttttctttctttccatggcagctttgcgcaatctcacctgctctaaaaataatctcttagtattttccgcttcagaggtagatttttcattagatgtttcggttaacgtatctttaactgcttcattagcaggtagtacaggagttgcctccttttcaaaaggggttcctgatttagatttctgctctaccccatcattcttctcttcacctttcgaagctttcttttcttcgtggaattttttcaaatttaaacgttcaccagttttcgtagtgatttctatttttgtagttttaggtgtagagggaggttcgggattagtgttgagtggttggtgtgtatatggtggagaagcaactggaaccatttgttggggtatataatacatctgaggagcatagtagttagctggccattgcatacctggcaacattgccgggttatagtcgttgttattcagtctgtagccattattgaatctgttattgtagtactgtgcatttccttgactattattacgattattgtatttatttgtcccgtatttgccatttttcgactggtattgcttgttattgtgaggttcccttgcactgtaaagattttcattgtagtggttatttggctgactattattggctccagagtattggttatcatgaggaggaaatttcttgtagccattggcttgctgcgggtgtgggggcggtggacctctttggtcagtcatagtgcctacaattgatctattgttctttgtaataaattctttctttcaggaacagtaaaaacagcctaaaaatatgaagtcgccgtagtaaacgttatcttctagttactatcaacacagacgcctttttaaattcgagggtcaaggctgctaggctgagtggtcgtttgctgtgtttacctctaatcaaaaacttattatcttttttttttcagtcctttttgcaaagcaggtacctactatttttcaaaatacactaaaggaacgggccccccggcttactattaataaggtcaggacggggaaaaagcagcaatgctctgcccctctgttctcgaaaagacaaacggttgttatatcctgtatatccagcggtataattttgcctcttagttaatgctaaactatgatattatacacatacactaagtaacatatacaatgagccaagtgaaacgaatacatcacttgaacagcttggcgacagaaatggccgtttcttggttcttgttcataaccttacccacagcgagttcgaagtcttcttgagtaacgtgtattcttctttctcttaaagcatacataccagcttctgtacagacacctttgacatcggcaccagaacaaccgttcatcttttcagcaacctttctcaagttgataccacgagttagattcatttttctggaatggattcttaaaatttcagctctagctgcgacacttggaggtggaaattcaatcttcctatctattctaccgggtctcaaaagtgctggatctagaatatctagtctattcgtggccattatgatcttgatatttttagaagtttcaaacccgtccaattggtttagtagttctaacattgttctttgaacttctgaatcaccaccaccagaaccttctacacgagtagagccaatggaatcgatttcatccataaagataattgagggagcatgttctctagccatcacaaacagctcacggaccatacgggaaccttcgccgatatacttttgtaccagttccgcaccactgaccctgatgaatttacaatcagtgtgatgtgcgacagctcttgccaataaggttttccctgtaccaggggggccatataagatgacaccctttggttgcgcaatacccaaactttcaaaaagttcaggatgttttacgggcaattcaataacttctttaatctcctttatttgctttgtcaaaccaccaaccatatcgtatgtggaatcaggaactttttccaccatcatcaacgaaactagtgggtcagccttattctcaagaactttatgcaacatataagagtcactccttagacaaactctttgagatgcctttaagtccttcacgtttatatcttttgcaacatccacgatgtattttccctcaggttgcactttaacgagaacttttttgtcagacacgatctttataacttcacccacataagatccaggttcctgtaatagacgcagttcgtccttgataaaacgtactttgtcattcaatgcattcctttgagcttccagtctgcgaacattttctgttttggagcggatctttaattctgtttcttggatcttctgttcaaaatatggtttgataccactttcgtgggtttctaatactatattggaggatgttacagcagctgtcattgtcgtgatagtatcccactatactgttgttccgtttacataaaacctaacctaactgttactgatattacaacttttgccacctcgctcgcattttgacagttttaaaatacgaaaatttccgaacaagaataagggtagagaagtatgcaaaatatgatttcatattaaaaaacccaaccgaagaaaaagggaaatagaaaaacaagttttcagtcgcaaaaagaggttaaacaaacgagtcagaagccagctctttcaaacaatgggtattattgaagaaaaggctctttttgttacgtgtggggcaacggtgccatttccaaagctcgtctcatgtgtgctaagcgacgaattctgccaagaattgattcaatatggattcgtacgtctaatcattcagtttgggagaaactacagttctgaatttgagcatttagtgcaagaacgcgggggccaaagagaaagccaaaaaattccaattgaccagtttggctgtggcgacaccgcaagacagtatgtcctgatgaacgggaaattaaaggtgatcgggtttgacttttcgaccaagatgcaaagtattatacgtgattattcagatttggtcatatcacacgctggaacgggctctatactagattctctacggttgaataaaccgttgatagtttgcgtaaacgattctttgatggataaccaccagcagcagatagcagacaagtttgtagagttgggctacgtatggtcttgtgcacccactgaaacaggtttgatagctggtttacgtgcatctcaaacagagaaactcaaaccattcccagtttctcataacccgtcatttgagcgattgctagttgaaactatatacagctagttagtaagattttaaaagacgaaaagaacggaaagtaggacaactaccaaaaaaaaagatggaaggtttctttggttagttagcagtatccgcgtaatgccttagacgtttttgatcagaaaaaaataaaacttgatttcgcccaggatcgaactggggacgttctgcgtgttaagcagatgccataaccgactagaccacgaaaccagttttttgatgtttcgtttagggacaagagtcctatgagagtccactaaaattctaaaaataattgtatcaacaaccgtcatgcagctgttgtatcaagaatcgaccaccatctatagactattgttcatagctgtattacaatatcatataagatgtaaggatagaacgtgaagatcgagaaacagtcagcagatttaatggaagctgaaatgcacggattgataatgtaatagaataagtgacaacataagaaatgaaagaaaaaaaataacattaatataatttagaaatgttagtttccttctatgaactctcgtatccctggggaggactttcaatatattcagtatacctaccgttcaaatgatactctaaaatatcatctattaagtggtattcaggtttttcccacgcaagattgagtgcgtcaggcaaagccacgatcgcagattactctcctaacaatattaagatcgtcaagaacatccggttttactcaagcgcttaatacaacacgtcggctttcgctcaactgcagtatattgtgtctgtaacctctcccgtcaagtttgcgccacgggcccaataaccaacttctgcgccattgttacggaaaagtggccatctttgctatgctcgtaaggctagcgctctctaagtacgccagcccaaaaactccgtatcgctcttcatcggaattgctatatctacagccgacgggcactctatgtatactcatatcacagccactgttgcactacattattcgcagggactccgagatcgctgagcatgttgctaagcaacttaccaaggttggaatgcattatatagtccgatatagaccccgctcggactatattatataaattcaaatagcactttcaacgagtgtcttaatccgtcctagttcctgctctcgctccacgttgtcatcccacccattcgcacgggtcttctgtgcgaatgagccacaacggggccgagttcagcgcgtgtccgcctacaacgtccgccaactagtggcaattgctaggctacgccgaccacgctgacacgcaccgttctactcgctctatgctgcggtgtgacgtgtgaacgcgcgatcgttcgcaatcgtatcgtttgccaagaaaaaaagccaatcggagaatctgaaaatcgctattcggcttgcaggtcgcacgcactcagagtacgaaatgccaagtaccggaatttccttggccttttttaagtttcttctcttctattctttttcccctttctttcttcctttgctatctgtctggtttaaataaacatagtatttttttgtgtctaagcctcttcctcttctctcgtacttgctctactaccactttacttaatcgcctttctttgttttctttcttcgttatttgttcttggacttttccgctccaatcccaacgattggcttcaaaacacgttctactgtctagcaatttctgcaggtgccatttttcttaggcttataccctttccttttccccttacatttgatttcttcttcaaagttccttatagtattattgtctaagctctattgagtcaaaagtaacaatctagacgaagaaaaaaaaaaatagaaaatagacatccccgaatacgcatcatctcacgcacgtacaagattttaacgttaaagccaaagtacgctagtatagtatcatcagcatcaccctcactatcggtagcattgaccaaacatgtcgttactgagactgtggaacaaagaatcaagggcaccatcaaaaataaagagtcatggtattgttggcagttacggcaacagcatgctggcccataacaacgtgaagcaatttcgtatagacatagacgaaccgcatagagtatggaaaccgaatgaaagcataaccggagaagcggtcattgacataaagagagacataactaacgtagcgatcaaattatcgctagtatgtgaggttcgcgtgaaaacggggaacagtccaacctccaagaataagagaattgagaaaaccttagagaagtcgacgtttctttatggacaggactacgtaaagacagctttttcggctaaggaaaagaaaccgcatgttgacaaaaccaccattctcaatggtttaagcaagggggaacacaggtttccctttaggatacgaataccacgaggcagaggaatgttgagctctataaagttcgaaaggggctcgataacatacttcctctcttgcactttagaatccctcaacaacatcaacggattaaaaaaaccggaagcaagatgcgaacgtgagtttgcagtcatagttccgctggacgtctcgaggctgcccaagccgaaaactaagacagtggttttacaatcagcatctatggtccaaaacaaaaagaacaaatctacagaggacgaatcctcatcgtatacacaattaactcaaaagtctactacttctaattcttctagcagttcagtaaactccaagacgtcccccttaccaaataaaacggtgactatatccgtagacataccgcaggctggattcatgattggtgaaattatccctatagacgttaagattgaccactataagcctttctatgcccctgcgggtctcaccaccactttggtgaggatatgtagggtgggcggtgcaggcaaagatgatcctatggagactttcagaaaagatatatgtcagagtatctctcctatatatattaaccctgaaacgttgcagtttcaatctagagtttatctgaaagtgccccttgatgcattttcgacccttactactgtgggaaaatttttctccttccaatactatatcgaggttatggttaacttatcaaaaaaaaacgtggtttacacagaatctaatagaataataggaactcctattggagaacaaaatggcttgggcgtagagaataatatcaaccgtatccaaaggaaaatgctacgtatggtcaatccagaaacgttggagaacgattctgagggttatgaatccagtatatttttcaaagatatggtaaatgtggaaaagctaaagagactgaggaatgtaactggtatgtccatagaaaccgtcataggaacgacgagatccgaacagcagcaatctgatgcaagcatcccatcccaatcctcaatcacggctcctcaaaattctccatcgaatttaagagattggttggccccattaaatgcatatgatagtgacgatgttccagttccaaagtattcgccaaatgataaagtcagtgtaccgtcggaagacaaacaagaacttgaacaaaaaagactacaacagttagaaagcgatcctcccccttgtgatgactattaaaaagtgcaggtaacaagtcatatactcgcagcttgcgccgtgttggaactaggcgccttaatcatgtttgcatatttccactatcccagccacgtaatgatccatgacattaacatagaaaaaaaaaatcgaagcatgcacaaacctgagatttatatatgttcatgtgtacttaatatacgtttaatgattaaaactatagccgtcctcaggcaaactgagataagaaacgaaaaaatagcagtaacgtaaacgttattctatatttataaagacgtacaaaaaaaaagtgattgtgatattgagatgtaagctatataccgaactttgagctccctcacgtggaaaatatgatagattgttgcctcatcattgcggaaccgcattttttttttgtatttttgcctccctagtttcaaaatgcaccaaattctccccttaatgctttttgttttaagtcccaaatagccatcctttcatcatcgggcaagatagaaatttgactgtcattcagttgtaacacctgtttcagtagttctttctgtttgttaagcacagctggatccaccacctcgttcacgctattgttattcgtagccgatgcctcttcttgcggcctggaagctaacgggatcaaatcatccactttacatatcccattcgttagcaataattcagccgtaacaaaactcaactgtggacacagctctaatagcgaaacagcatcttcaggatgcgctcttgtccattcttggaatttttgtaaaaatttcaactgcacctctttcggttttttagctagttcgctcgatatcatcatagcaggggtggtcatgtttatgttaacgtcgataccagagggcaattctggaaacttttgacttagaaaattggcatttccgctgttttgaaagtccggcccattactattattattattatttccattgttgttattgttcccattaatgttgttgtactgttgttgttgctgttgtgaaactcccgatatatcactattgctggagtaaccgcatttcaaaaacctagagcctaattggtatccattcaaattacgtactgcgctggcactggactctaaatctctaaattcaataaacgcgtaccctttcgacctaccagtttgggggtcgaacatcattttcaaattgatcacgggcccaacattactacataaatcaagtatctgctcctctgtttgatcgtatggtatagaacccagatacaccactcgggatggtgggttgttctgtacccccgcattcacaccgctctgcctattcattttatcgttttcgtcttttctttcaatgtattgataattaacgtgtctatgtgatgctattggtatatagcctttcttgtatatccctctaacaattattacaagtgtttctgtttaaagcaagtgctagaagtgactcggttctcttaggaaattctaaacgcaagatttctcttatggtgattgtaacaattatgagatacttcactagcccaccttaactttacggaccttcttttgaaacgatgcttcgaatgacaacgcctttttgatatataatatccaatttcattatagggaaattttcaactcttacccgccccactgtgctgatatgaccaagtgatcactcgatgatgggactacgtattgaaaaatattgaatgaaaaattactcaagcagcagaacattcacagtgtagtcagtccgcataagagcattcatcatggatagtaaggaagtactggtacatgttaagaatctagaaaagaacaaaagtaatgatgctgcagttctagaaatcttacatgtcttggataaagaattcgtccccactgaaaagttactgagagaaacaaaagttggtgtggaagtcaacaagtttaaaaaatccactaatgtagagatcagcaaactcgtgaagaaaatgattagctcttggaaagacgcaattaataaaaataagcgttccaggcaagcacagcagcatcatcaagatcatgcgccaggcaatgcagaggacaagacaactgtaggtgagtccgtgaatggtgttcaacagccggcctcctcccagtcagatgccatgaaacaagacaagtacgtcagcactaaaccaagaaatagtaagaacgatggtgtggatacagctatataccaccacaaattacgtgatcaggtactaaaagcactctacgacgttttggccaaggaaagtgagcatccacctcaatctattttgcatactgcaaaggccatagaaagtgaaatgaataaagttaacaactgtgacaccaacgaagccgcttacaaagccaggtatcgtataatttattcaaacgtcatatcaaagaataacccagatctcaaacataaaattgccaacggtgatataacacctgaattcttagctacatgcgatgccaaggatctggcaccagcgcccttaaagcaaaagatagaagaaattgccaagcaaaacttatacaacgcacagggtgccaccatagaaaggtcagtcaccgatagatttacatgtggtaaatgtaaagagaagaaggtatcttactatcaattgcaaacaagatctgcggatgaaccattgaccactttctgtacatgtgaagcatgtggtaacagatggaaattctcttagaatagaaaaagatgagagtagccacggacagagcaaaggaaacaataggaggaagggacagaaaagcctgttctgactctattcgtagtagtatttgacagccggaatccaggaaaagaaaaagccaaacatacaaccatatccaatttgttgaaatggcatattcatatacgatgtacatatatacatatactgctggtgttaattttttttgtctgtctcacgtaaaatcttttgttcgtccagttacttttaattatttatgattttcatgttttctttattaatcttctatgcattaaatatggctcggtcagaactaaagaaatacaatttaagatgtaacaaaaccgacgaataaaaagttagaataaacacaagaagcagaaagtagatactacagccacacataatgctaagagttatatggaagcatagttccagagtcactcgttcgatagaactatcgaacatttctaccactaatcacaccaggagtttaaggaggctttcctggatttctccgagaagattttacgctcaatcttgggacgacagacagcctaatgacaaaatagatgcacacataaaggtgcagaaactcatggatcaaataaattcgaggcctaatgttctggaaaagttagaaaaggttagcaatatcatgatcgaaaaaaaattggttaatctagatgggacttctgccaatgaagaaaatacgatgaaaccatggcaaatgattaagatcttaatggacagagatctgagacacgctatgaaggaatttaaattggaattggaaaaatctggcatacagttaggacctgaacaactggccccgctaatgaccgttttaggccttgagaagaaaaaatgagaggtgaaagtaaaaaaacattacctatctgtcttactagcgccttccgtgtataaatattacgtactactacataaatactcattaggaggattacataatttccattgtatcgtatactaggtcgcatctttgcatattataaagcttgccaaatagggatatactgccagcactgttacatttgtcatattgacatcattatttttactattcacaaggtaagcacgtttttttttagttttcttcatctaaccagtctaggaactcaggagccaaataagtgatgattaatctggcacccgccctcaagaaaccttgatgagattcaaaggcaattgtcttcaaatcaacaacacctttttcagctgcagcatgtaacattgcgtattcgcccgacacgtgatatgcgcagattggtaagtctttacaaatttcacttgcatccctcattatatctaagtagaaagtggaaggcttaacaataataccgtcggcaccttcactcatatccctttccaacgccctacgtgccaggccacgaccggcaggaggtaattggtaacatttcctatcaccattcgaaggagctgaacaagcagcatcacggaatggcccatatagattaccgctaaacttagctgcataggataacacgaaggtcttgtgagccaagtttgcatttattaagcctcgtttaatatctctgatcctaccatcgatcatatcactgggagccacacagtgcgcaccagctttagcgtagttaactgccacagctgctaatctagagacactacgttctctattaatagtaccatcatcgtatagaaccccgcaatggccatgagaagtgtattcacagagacagacatcgcaaataatatacagttcagggaaatactcacgaatgaatttaataccttgaatgactggccctgcaggatcgtcagccgctgtacccactggatccttggtaccagggatgagaggcacaccaaacaagatcacagaacgcaaacccttggccactaatggctttaagtagtcttttagcctatttacaccgattctattgatattaggtagagagtcaatttcagtaaagtcatctggattatcggagatgaatagcggaaaaatcaacatgttcttagtcagttgacgctcactttgccactgtctcagcagtgggtgattataaccacctgctagaacagatgagatttctgttggttctgtttccaaaaattcagctgtatgcatggttttgtcaattttctaggtatgaattactggagtaagcaataatatgagtaagcagtaaaacttttttttatttggctgattgggcaagaaaatcaaagacaatagagtggcgcatagatgttgctagcatttattaggttgccttactcttatataaatcaagcgggaagcttgcctcaagccaatcaccgcaccgaacagggattgctcgtttacccgtattttgatttttttttcaccttttccaatttttttttcggcaacaattttttggatgatttttatcgtcgatcttggaatgatgatgtatttcggcgtctctacaagacccaataaagtaattcggtgacacaggcttgtagcagatagaaaacgttccgaaagatgggttccaattgatgtaacacttcttttttatatattcatgtggacgtgtacgccttcttcccttctttgcctcttgtgccactgttaatcctcttaagcatattgtttttatttacagacattggctgactcaccagaaactataattgacgctgatttctagttaattaaaaataaaatatatgcaagaattagcaccaggcagtcatttctgtaaattgctttgttttctatttcaaatttgttttttgtatatgtttcaatgttctcgtgacaatgcaggcttttttttgtgcgaattaaagtaaagctaatcaaaactaaacaataatttatcttgttcccgaaagagtggatcatgaggaggaaagctaaccgtccaagatcctatataatttttgaactgaaaaccaactgttcacctagaagacaggtatctggatatgtaactacacgctctataaatacagaaatcgtaagctaatcaatataaatgtaaaagaaaataggaattgctgtcgatagatttatttacttttgtattgtcatctgtgttctgtgccagtacaccggactcgtatgagctgtatggtgtcgtttcaatagaatctactgtaataatcacacagattagaaattattttcaagattaaatatgacaatacaccttggaataaaaacacaggatctaatagtggcccaaaatgaagctcgacgtgaaaataatagagccgtgattttaatttcatgattggaagacgttttcaaggatggttagactttgggtctgaaagcactgtctcgtagtccatatataaagaaaatcttatgggaaactggttacattctaatgattttagcaacaagttgcagctaagagtttgaatatctgaacgaagttgtcggtacttctgccactatcagtataaataattgccgccgttccatgatatggagagcatggcaaggtttactctgatcttggccattcttcattaatttgtcgtgtgaaatgcgcagtaatcaaccaattttctgtcagcggtatttgaagccctaagatgacacaaatgagaaagcgttttctcaactagtaatgccaaattcctcccttctataaaaagcccctaactccgctgcattcaattgcatttttcattaaaagaataccttgaataaaaccatgcgggaacatatagatatataaagcagaacatttttgctcaagaacagaaagttccaatggttatctataggttccgtttcagctttacgtacctcccagtcaaggtacgattcaaagccttttaattttttatcccaaatagagcacgatgtcgcaatcttctgagtgttaaactgtcgccaaatctgtatttgggtatagccatttcttccaaaattgctaggaatggccttataagctatattgtgcttgtgcttgcgtttgcgtttgcatttttttttttgttattttattacttcgtcacaaggggtacaagagaactcttatccaactgaccacagctttgtcactaatttctctccagaggggaatgtccctttgagattatcgaacaggaatgattggatctattgcactaaaatgacccaaaaacgctctagtccatgctgcatcctatcttccatcaatacagaaaataacagaaggttcatcagctcatatatagagaagaaagaaaagaaagaaaaaaaactctgtgtagtgtaatacaactgactaacgcacccaccgaaagagggtccacgaggaatagacagtgcattatacagaacgtgctgaaaatgtagaaccttccttgtgaattttactccttgtacttcctgagataatatatgaccttctgaaaggtaaaagagcgaccttgatcctgcaaatttagcgaatatttgaatcgattttcatattttttctatattaaagcccaactactgggaccgaatattttcccctacaaaggctagaagacggtgaagccttcttgtaatttttatttcgttttagtttagttacaaagtgcttttgccattgcatagacgagcagcttatcccataatgaataaattctattcaaactaataataactaatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaaccattatttttttccatttaaaatgatctttttaccgaccaggcgtcactaaccacgaaaacatagtttaaggtattttccgttttaggcgcaatgaatatactgcaacgtgcctattgaatcctattcgaaatcacctccaaagttatgttgccgattaggcaaatactctaaaagtatagtactaaagaactacgtaaaggtaaaataaaacacctgaatttcatttctgaaatgaagtaccatcatgaaatatgatgaaagtcaagactcgttgggtcaatatacaccacaaaaaaaggtacacacgaatggtttaaccctttcggttccttctgtaaatcgaaaaatgccctttatacagcgggttggtctcccatcaaagttgagaagcgattagaaattaggttacctaatgaatccataaataaatggaaaacgctattttgttcgaacgatggaataaaaatatgaacgggtgtcattgaaattcggtgtattttttgatcgggcctgatctggctcgggtttggcacaatttggcttggttagttcggcaaagcttatttaaagaacctttttggatagccaattgagagacttgaaatagaaagatcgtaagtatttttatgaacgcaaaatcaatcttggtagcccagttagtttctcttcactaattccggagaacaaaaacatatcatacgattgtgtgagattcaacaaaaatcgatcagaaattttttttgaacagaatagtcatgactactgaaaaaaccgttgtttttgtttctggtgctactggtttcattgctctacacgtagtggacgatttattaaaaactggttacaaggtcatcggttcgggtaggtcccaagaaaagaatgatggattgctgaaaaaatttaagagcaatcccaacctttcaatggagattgtcgaagacattgctgctccaaacgcttttgacaaagtttttcaaaagcacggcaaagagatcaaggttgtcttgcacatagcttctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgcggtttccgcatactgtggttccaagaaatttgctgaaaaaactgcttgggattttctcgaggaaaaccaatcaagcatcaaatttacgctatcaaccatcaacccaggatttgtttttggccctcagctatttgccgactctcttagaaatggaataaatagctcttcagccattattgccaatttggttagttataaattaggcgacaatttttataattacagtggtccttttattgacgttcgcgatgtttcaaaagctcatttacttgcatttgagaaacccgaatgcgctggccaaagactattcttatgtgaagatatgttttgctctcaagaagcgctggatatcttgaatgaggaatttccacagttaaaaggcaagatagcaactggcgaacctggtagcggctcaacctttttgacaaaaaactgctgcaagtgcgacaaccgcaaaaccaaaaatttattaggattccaatttaataagttcagagattgcattgtcgatactgcctcgcaattactagaagttcaaagtaaaagctaaaattaagctttcgagaaaaactttcttttaacccctctaatctaaatataaacatatagcttatagaaatgaatgaatattttaaatagttacggatacaaagagttcattatagtgcgggcagttagtacggtatcgatttatcattggagatctgcagtgttacagaagcactgctcaccagttgtctacggaaggacgttgagatagttttaccacgtttgagctaaaagtttctaccacaagagcctttatttgcacatggcagtgaatgcatgattaaggatatgaagaagaaaggaataactaggaataaattttatttagagagggtatgatgaaaggagagcctcgttatttatgacctgcatttttatcagcatcttctttccagctcccgctaaacatgtgctttacaaaagccattttgtcgtcactagactgggcgcccatctgccccacatctggtgaaaaacttgttattggtagaaccatcacatcatcaacgataactggttctttcaaaaaagagaagaattcccagggcattgaatttgacgattgcaaagactctgatattttcttataaaattttcttgttgatttggacagcgtatcgttatcaacatcttttgctggtgtggtggcactctcactaccttcttcgtcgttcttgtttaggtttgggttgattaacaagatatcgctattgtatcggagcacattgttcatgtattcgaaaataatgtcggagaaaatacctggacccgtccaattcattatatctgagccatcaacatttttgttatttttcaattcggagtgtttgtaggtctcatcatgacgtcttttgtgcctatagtttacgttgtagtcttcttcaaatcttggatcaatcatttcactgacaggaactcctgggttttgtacgctcgccaaagtcgttgcagtaatatttaagatcaattctcttagaattgggtgacctggtttggcttggatagtccattgacaaaactggatcctacgagcataccattcactccaatcatctctgtccggatctgcctcaatgccgatgaccaaacctggctggtgtgatatctcatcacttgagagaagtgagggctttgagttcttataaggaataggtttattcaaatctattatgttgtttagccatgacttattctgagaaggccatgaatcaattggcttcaaaagcatagtatccatatctgagtaaataccacctcttgcaaataataataggtaccttaaaaaatctgcctttaggatatttccaggcatcaatttaaacgcttggatgactatcggaacgggtgcgtaaagattctccaaaaaagggataatagaatcatccgaaatcagagaatattggtaatccggtgaatacgaaccagaccatgttttttgataggttctgaacgaagagggaaaattcttatcatctgcgccgactttccaggtctgccacaccctttgcgggatgggggcctgagagtcgtagggaaacgcaaacgataattgatcacgtaaattatgcaattgattttttttcttgttaactgtaatttgtttcttcaaatttatatcttgtgaatgagaagtcgtagggagaagagtttgcttgaaatcatctttgctagggtaaaactgagaaagcagccttttgtttgacaagtgaaatgtcaacaaagaataaataagaagtacggttacgactattgtttttgatttccttgtagcgatcaggtgggacaacttcctagacatgatctcttctttcttttacttgctttctttttccaaattgctattattgctcttgaaatgaaaacggaatcaaagaactaaaacaacctatccctattaaatataaaaggatgcagatggggagagagaatgtggattggcgagaaataatgtcggtattcgaagaaggcagaaatactaaagtggctaccaagctaccaaactaccttaatgcagaagttttgacgttgctgtccctgcaacgtgaaaagtccaaaaaggcgcgtttagttgaggcccagccaaatcttttcgcggtgggccggccaaatagtttaagcaatttacccaaaaaagaataaagagaggcgtaaagacgttagttaatattttattattccttctccatatgtcggaattcggtgtacatacatatatatagatattgttatatagatttgtgcatttgcaagccaccctagttcatcaggttgaagaagtattattcagctcttatttatccacgacattgatgttgtgggccttcaactcttccttaaccttattgatgacttcgggatcatcgctgatgggtcttgtgtaatccagcaggacagtggtcttataacctagttctgcagcggaaatggcggtggctttgacacaatactccaaagctacaccgacaatgtaaacctcgtctgtatgatgcttttctaagtacttgttcatgtcggtcttatggaagttccagatgtcgtggaaggcggagtagtattcacggtcagtcaagaaacccttgtcgacaatcttaatatgcttagtgaccacttggtccattatttggtcaaccaattgactaccccaggtgtttttcacacagtgtacgggccacaaaataccctcttgcgtggaatcatcgcctggccttggagagtggtaggtgtatgttgaatagggttctttatctttatggttctttgcgaacgaaatatgtctggaagggtgccaatctctggtgaccacaatcctgtgccagtctctatcagcatcttgcatcaaatccgagataggattgattaattcctcaccttttggaacagtcaaggaacctaaaggtgaaataaaatcattttgcatatcaacaacaattaaagtcttcatttttgtactgtattttattctttctaacaaagatatagataatcgtaaaagaaagttttgtttgaaggtttcctcacctattgcatccaaccaggtaccagttaagagtacattgtatatgaaaatatatatatgagtaatatatatatatatagttttattaataactattagcacatcataatcgtatctggagacacatacatagtgggccaaacggaaacccctgccccttgaagaacttttttttcataattcacttttccagtacgtaacaccacgcggcgcccctttgtggggcctgccccttttttttttctttcttttttttcggaaacattccgcgagatttcggcacgtcccaaatgatatcgagctaacacgtataaagcgataacgtatataacgacgtatgattttagcaacggaagacgttaacaatgacatatggatatttatttatatatataatataaaaatttcattaccctgtgtgccaccttgatccttgacttaatatatttttttctgcttggatctcggcggcagttttttctgtttcatataaggaggatcgtagggaaagaggaaaacaaaaggcataattaaccaatagcaacaatataagcagtacagaaccctcaccaccagaatgcagaagtgtgctggccatgcaccactggtgactgcagcctcgcgggtctcccaagacaccgtagacgctcttttgcaagctattttaaaggcctaccataaattagcttcgatcgacagtcacattaatgatcctgttgaaatagccttcaagctcataaactcttttaagtatctgccaatttcaggctcttctgtaaaagattttgagtcggaactgcgggagttagacgttttttctccccttttgcagtcagccgttactgctgctaataatagcaatatcatatgggaccttatagcggtgttatttgcatacatttccatccataaacagctccatcctttgatcctgcacaatctgaacatatggaaggattttatggcagataatgacgaagaaacggcgacaaccacggacggggactcaatgaatttcggcgtactgtcgcttctttccattgttcaaaattttgaagaaataacgccaaatctatttgagtttctaaagctcggtttgagatccactttactcaagatatgggtagcacaatggcaaagatacgatccttcggcaacgaacttaatcaacggtgatgagaaaatttctagctggataacaaaggattaccaggtggatttttttatcatcacttcattagcatcaacgtcctcattagaagttttgccatctcattattttgtgtacaagatctctaaaaggatctctcacttcccaaatttaattgatcctaaactatatcgatctgcaatttctacaataatggaaaatgggatttcagacaatggtggtggtgagaactccagcgacaaaattgatccgactgatttgtcctttcacttacaagttttaatggaagttattgaccatcctgagttgaattatttgcaggaaaatcgattaattttgttgctcgacattgcattaaattatttaatcctggttcctactcactgtttacattcaaactttggtgaattgggctctactcaaagtttagcatccactttaaatatcattcagttccttctatcgaaattcttaatcaacatgggcagtatttcgcaattaattaatcaatacaacaggaaatgcatcactactaataacatcaataataacaacattaacaacaatggcgttattaatggtagtactaacaccactagtactactactactaccatcactaataacaataataatagcaataatagcagtattagtaataataacagaaaaatagactggacgcaatcatatcaaacgaggtaccaaattccatactggtttgaggactcaattttgccaccaattccgcctatttcgaaatcgcttttcacttttgacaagaacctagaccatgagtcggattcaattatgattgtaaatgatgtattacgctgtttgaatttaaccattcttttaatttctaaacttctaagggattatgatgacctgaagattaacccactaattcaatcatcagatgatcacagtaatgaagacaatcatgtgataatagaacaatacatgcagctttatctcgttccattatttacttcattattattggcccaacaattaaaagaccgaggccaagaacgagatgaaggacataaagagaaagaggaaaatataaatctcatcgggtcttcctcagtcaagaaattattttctcaactaattttttttagctctttgaaattgtgtgaaaatttggtcataaaggaaaaaaatttagcactatatcatttgatcaaattcgcgacaaaggtttctctggatgatttgattttacaaaaaatatccataaacttattgaatcatttgttcttccatcaaattagggatggaagtgatgatgataatttaattaaaaagttatgtttaaaaaatcaactttctttccaagctttgaaagattacatcacattgtggaatgacggttctgaagtttataatgcattttataaggagcttttctatgaagagcaaccaaagattaagccaataaaactaacaacatctgacttgctgaaattattccctgaggatgttcaatttgtgatatccactccaccaaatacaataacttcagcatcaacaagcgataattgtacatcatcacaatcagctgcgcagaaaaatattgaaaactttactacgttatcgaagtacgatgtctactcgtccacatctttcataccgtccacgtcgaaaaacactaacactaacgttagtaagcagcagcagcagcctcaaaactctactccatgttcttccaacaggtttttgttcaacaaaagcagcctaatttctcaggaaagtaatggtagcaacaataacagcggcacacaaggacctggttccatgaatgagagttattctcttgacaattcattcaacacaaccaataccaatatgacgagacaaccaaccaccttaactagagcaaccgatgctatgactacggcacctacgacaccaattccatacaagaacactagtggaagcagcaataacaatctatggattgaatcgcccatgacaaatttcaagggttccaccatcagtaaaagtactaataagagcaaaatggttaatactggtaaaaattatattttagggggccacaataaagttaaaaacaacagtagagctcaatcaatacatatagatgactttgaaaatgagaacaattaattatctctgcggaagactaagacaatcaaaatatgtattcttactatcataattaaatatttttatcgttattaattattattattattattattattattattattattattattattattattatttattatttattaattattaattgttaatattattaattcttgtctattgtcttttgatttatctgcaccgccaaaaacttgtcagcgtatcagtccatgtgtgggaagggcaacggtaaacttcttatgggtggtaatgtttccagttcttgaacttgtgaatccgactgagaaatgggggtttgttgggtggatatagcagtattaatcatattcacccttggtgacaataataacggggttgtacttaacgaactactggaagccatcatttgattttgattttgattttgactttggtttgacgtattttgtgattgcagtagggtatgttgctcttgctgctgttgttgaacgttcagtaatctgttgttcaactccttttggaaatcaggagatgatgaggagaaatgcaagtgattttggttcattacataccccaaagtgtgcaaattcgtaccactagtggatctacttagcattgtcgtgggcgtggaagtcttagatttctttcttgattgctcttgcaaatagtcttgctcaaggttatcgatactagagttagacgggtcctttagtccgtcttcttcatcctcaccaccagtagtaaaatcagagtcagattcgttggtatttctttggccaaccaacaagtcgttcaaacttaaaactgaacttggtctcttcaactgtacggaactctgagtttgtgctctgagacttccattgttgtttggatttgcattgttcaatccttgaaaatccgttaaagatcgcggccttggtaatataacagtgttggaataacgtggtgaaagagaattttgttgttgttgtagttgtttctgttcaggaccgtctatgaaaacagtccttggcgcactgctagcaatgggcgtcatcatttgtagggacgataacgcgttcagtttcagtctactgccactatggctattgctcaacgaagacaaagcagtggaagcggatgaagtttggtagttcatattattcagtgctaaagaaggtggaggcttcaccgagacgggaatcttagccatcgttttgggagaagaaaccatatatgggtcattcccaccactttcgccgatttcgaatttggtttttctaccttttcttgtagaagatcgacttgaattttctttcggagcaatagcaataggaattaaaggcgataggtgttgctgtggtaatggcggtgaaaaatttgccgtatttaaatctggtatactggtagcactagaactagcactatttattggagagcccacaaccttcttctttctgcctcttttacctcgagggtgggagtttgtatgaattcttctgtgtctcgtcagttcatcgcttctactgaaccttttcacacatccggggaagtcacacgcgtgaggcttctcacctgtatgaattctcatgtgtctcgtctgatgttccagtctgtgaaaagctctatgacagataggacaagcatgtggtcttggcgcctctgacttcgcagctactttggacttgcttttactctccttcaatagtgacccatcatcaacgttagacacttgtgtcattggatatgggctttgcatggctatggtagtatgtcgtctccactatactcaactctcgtgtagttacaagcgagctagaataaatggctctcttatcttcgaaatgctttaccgggctttcttactctcctttgtcttcgttaatgagtactggggtgaaaaaaaagggttataataaataaattatccaagaacgactattctcttttcttttttctgcttgctcttccccacttttctcgtccagcctgttgtaaaaatttgttgttgcttctttcgtattagtttttccgaaagaaagcgccgcagggcctttaccatcactccaggttttcccggagtggggtggcagtccgcagtctctcgcgaaatcaaaggcaacaagcagacacgtggagaaaagccaggagaactcaagagctcgaacaagtatgctagcaactaaacaagccggcctacgccactctggagtttctcgcggggcccggccgctacaggtttcctgagaagccattataatggcaactacattcatcaacactccataaaatcctatcgagttacactgctagtgtcgcaattgcgcttttctgctgcttaattgtgggccccaagctcttatcacttgctaccatcctataaactgtatggaatgccatcacaactttcggaaaaataaagcgcttttttacgctatcagtggagatattacgaattaggcacagggaagaaatagataaaaaattcatggggccaaccccagacgtcaatcttctacacgtcaagttttgaaaaaaattaaataaaaaataaaaaaaaaaccggcgcgaaggaaacgtgctggctcgctaacttctagtcttactgtactgactaccttccagtcctactggttatactgcattgtacggcaacttacacaccccacgcacttactttcctccacaatgccatctagaaaaatcgattacccgctaattttccgggaaaaagtcgattaatgtaggttagtggcagctatgctaagcaatgataaaggaaccatacacgatatttctacagaaggctattaaatagggtgaaataggatgaagcaacaatcaaaaattatgaaagcatccgttttctcgctattctaataatgggacagaactgccaattcttgatctggtgatccatacgattaaaataggggttcatcgcatggaaagtctgtaaatcacacttgcctaccataaggaagtcatcaattcccgaattttaaacgggtttctatgagtatttggaggatgttcattcttggtaacattactgatgacattcagtgatacactgccttcaaggaaacacacgcgatagaggcaaaacaatgttgcaacggcaattaatttctgtcattgtaatgaatttctgctcgttgcttctaaccatatcttgtgtaacgcttgcgttgatatgcaaaaataacgagatggaatttgctgccctctttcagccatatgatggcggcaaaaactttgaaatttgtgcacaggatataataagctacttcttgactctaacgccgtactacagtttacaaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacatatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacattgcttacagttgcttttttatgaagattcaaaagattatgtcctcggcggctaaattttccattaataatattatccttttacgcgaccgaaaaagagaagcgttttaagagttgtttctaacaaatattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaacggccaaagacgctcttgactctgtaactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgagaccttttcttttgaatatactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagggaaatcaattgcctgatattcagtatattggatctgaaggtatgaaacagtcccttaattaagctttagatgcggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtggatggtagattatacctcgcgaatgaattatacagaaaataatactaaattgaaatatttaaaaatgatttaaaagaaaaatattcattgtacataataagttcgagcataaatcttaacgagaagtagcagcaaccttttggaaagcacccttagcttgttgcttggagaacttagaactttgagtaccagcagacttagccttttcagcctttctagcagccttttcagccttcttcttttctttgttggccttcaatttttcttctctgttagcctttctaacttctggcttcaaagatcttctttccttgatcaagtccaaagaagcaccggtaattggtctttgggccttaacggtttttctagatctcttcttagcaacttcttcggtgatacccttcttgtgatgctttctgaataagacagtccaagcgattcttcttgggttctttctttgcttgaacaaagaggcagatttggagttttggaatctgaagattttggagtcaccacggacaaacaaggtacctctgcctgggtagattttggcacctgaaaaagaatcgatttcaaccttcattttatcactatattaatccacgtttttcaaacatatttgaaaaaaaaaatgttagtaagtctatgcttttcataggtagccatcttgtcaatataaataatggtaatccgcatggttgttcaggcgttcgcaaaattgtaggaagaggagaacgtggaaatatggactttttgcaaattcagaattcattttactaggttcttgcaacatggataacatctcacgctgttatttttcatgcttctccatatcgtatatatgtaatgaagcattttcattgggtttcctgctcaaaggttgacatatattataagttatactggaacaagccacaatcctgtcaaagtctaaattccggtgtattggctatctgaagctctctcatatattaatacattgctttctagcacaacgctgccctcggtcgccattaattatgaatcatcatcatatagggacatacctctcaagttattgtcttggtgtcttgcttaacttggcaatagcaacagcgcaaactgcgtaaacgtactaaaatacacaccatccgttgaatatatcatgcagtacattgacagtatatcacttctggataggacgccaaccgccagtctgtgtggtatttcctcccgtctctgcgtgccagacgggatcagcccgtctattctcgtgtcgtcctgcctggagagactgaacccccatctagcaccgcagtaaggatcattactttgtaggcgggaaataagaggttcaacaaggaccaaaaaaaaaaacactaaaatctgagatcaaaaatatgtggtgcacagatgtaacgttccaaaatgtatggatggtaaggtctttttccaagaaacgtatctttttttcagctagggccgcatttaaattttttttttttcaattttttttcctattggagacggaatggcaaagctcacgctgggcgatagcacgtaaccacgctggtgtattttcatcctaatcattctctttcatctatttcgataagctacttaatgtcgaagttttaacttccatttgttggaatgttcattacagtttatacttactccttgctcttttataatataaccaaacagaccggagtgtttaagaacctacagcttattcaattaatcaatatacgcagagatggtcagtataacatgattttataactatttcgctttattctttcatgggattagcaagaaggcttggaatacaaacatgaattttcaaagtttattcctgctcttgtgtttgagagagtccgttcaaaggatgcttctccatgactgtgaaataaaagtgagatatgcaaaaactttgaataatctactaacaagttaatacgttattttttatcgtttacatttcaacaggccccagttaaatcccaagaatctatcaaccaaaagttggctttggttatcaagtctggtaagtacaccttaggttacaagtccactgtcaagtctttgagacaaggtaagtctaagttgatcatcattgccgctaacactccagttttgagaaagtccgaattggaatattacgctatgttgtccaagactaaggtctactacttccaaggtggtaacaacgaattgggtactgctgtcggtaagttattcagagtcggtgttgtctctattttggaagctggtgactctgatatcttgaccaccttggcttaaataaggtaagttcaaacgatttgttggaagacaattggtttgatgtgtatttttctataatatataaatcttagactattcattaaccttattttatttaccttctacccgaaaatgggtttcttttgctgaaatagttctttcatgtaaatattgtttaagcagaaggcattctttgccctcttgctcgtgtgggttcctttccgctaataatcaatcattctcatactgttcaatatcataattatctctgcgacgatttttcatccgcctcctccgaaactggaaaaagcgatgagataaaattttcaggaatccatcagcaattttatatgatagatagaagtctattacgttgagcttccaattttaaaggaatactgtccatattcattgaaagcaaaataaaacataaccaggaaatatggtgaatgaaacaggagaaagtcaaaaagcggcaaaaggcactccagttagtgggaaggtatggaaggcagaaaagacaccgctgagggccaaaagcagagtcgttaagaacaagaagttaacatcatgggagttgaaaaaacaaaaaagactcgaagataaacagttcaaagaaagattgaaggctttgaaggatgagaaggaagaagctcgtcaagctaaaataaccatgttaaaggaaagaagagagaagaaggaagagaatgaaagatacgaacgtttggctgctaagatgcatgctaagaaggttgaaagaatgagaagaagagagaaaaggaacaaggctttaaaagaacgttagatcgaaattctttctaacaaaaaaaaaaaataaattcatatggataagcacaatggtataaagcattatagaaggctcatagatacacaggtcaataacctacaatggttaatatcttagcagtaattgtatagtaattttatttaagaaatatctctttaagaagaaaaagaggtgcggactcattattaagtcctgacaaggagaaaataagggcatccctagacagttattattcactaaaaactggaaaaaactaaaaattttttgaagcccgtatggcttattatgcgaattctgtggatcgaacacaggacctccagataacttgaccgaagttttttcttcagtctggcgctctcccaactgagctaaatccgcatatattttataggaaaatcatcaacacgtacaaaccacataaagcgtaaggataaaatcaaataacgtttgaactgacactaatcgggccaaataataggagtatttattttaatttattccttgacttgaataagtatgaaattttaacaaccattctaaaaattaaaaattgataattacctgaatgttataatatacaaagtgaaatgataatgtagatatgtaaatgaactgaataatcccgtatataagaagagtaagaagtactcgtgcacatttcaatgccaaacttacattcttgcttcctgtcttctttattttatctttaacctataccctggtgtatttgtagttagaaattagaaccgcaaatttgtaaaacatctatatcgttaatgtcgtaatggaaaagatctaattactgttttctgatcttttatatgcatgtttctctattcgatttagaaaacttatggaaaatattcaatcacaccgaaagattgttcgataccgtaatcaccgggagccttccagtaatcattgtaagtcgataagattgtaacatccaagtccatttcattcaagatgttttggactgcagtaatttggttagcagtggatggaatgttgcctccattttgaataccagacgatgggtaacctgtttccgtgacgaaaacattagaagtaccacaaacaccttgaattaattcaacttgacccttaacaaatgtaccggcagtttcagcactggcgctagtatcaaagtaggcatgtgggttgataccaacgaagtcaatatcagattttttgcacaaatcagggttattttcaaatgagacagggggctcactggtagtaatttggccagaatagccagcttcgcttaatttggatttgacagaggaaattttactaatcaaatcagaaactgaacaccaaccattattgatagcttcatttccaacagtaatgaaatcaaagacatcccaaccgttagtttgaccatattgaatcaatgtggtaacagaatcatctatggaatcaacgccgctactggtgatatacaaaccttggttaatcttaatacctagttttacggctgctggttggacggtttcaaaggaattacagtcggtgccataaacacggattttggaaatacctttagatttgatcaacgttaagtcagaagagacagcgtctgcagacttacaagagccatcatcattatatggtgaatatgcaatagcctttggagaagaagttatagcagcgctgctactagaggaaccttcagaggtggtagcggctgtttcctgtgtggatgaagtagaggacgaagtagaggacgaagtagaggaagaagtagaagaagaagtagaggaagaagtagaagaagaagtagaagaagaagtagaggacgacgtagaggacgacgtaggtgtattggttgattcggtggactcctgagaagcaattgaggtactcgtttgttgattcaaagttgaagtcgcagctgcttggtaagaatgatgctgactttgagtgttgccttcaacattggcttcaccgacaccactcacgatattttgtgtggaagtagacgtagtggtaggggaaggagaggaggagatagaggtagaagtagtagctaattgttgcacatcctcactagtacctgcagaaacagacatagcagtttgttgcgtagagacggcttgcaaagtagattctgcttgaaaagaggaggttgattgtggaatagtgcttggctgcaaagtagaggttggctgcgaagatgtactcatttcagccttttttaagagaactttagtgatagtcgtagttggttcagctgttgggttcacaccttgtggaattaaggttgttgtaaaggtaacactatcgcttattaggaattcgacagttggggcaataacaacttcggtagtagtggagtaaaaatcagtcacaacattagttgtgcttgctgtgtgaactctcgttacaacttctctcttaggaagaatcggtaaagctgaggttagataagttaagcatagcagcgatgatagaaagcttatgggtgaaatcatgatggttttctattagatattatatcaatgagtgtagcgtaataataagtcgataaacagtacagagaatagaatagatttattacagtggaggtatgtcagtaaaggcttattcttctaaaagagtggactgtctttgttgcgtaactgacgattatagtactgttgccttaatatataacagtgtatttggataagcagaaggaaaacacgatcattgaacttcaattttctttccacttaaatagtccctcctcagattcttaatttgttttcggtgcagcatattttgttgtcagtccttacactttaacattttgagatctagtatccagcttgtaaacaataacattccctaacttttattcatcttaccgcagtaaatagaaaagacctcacttcgcaaccattaatccccaaaagaaaaaaaaaaatgtgacatttcataatgcatgtttcgagtgtgttttcgattgtttatttgtctggcttttagctgcaatggcccagactgctagttaccagttgctggtttccacgattttttaactttttctcacagccgcatcgaaatgtaaataaacgcgagaaaaaaaaagctgaaaatgctggctctaactaagagatgcgaggcccttttcgaatagctggaacatttataattttcatcttgcatactggtacatatctggttacatatctgtttatatgactgaaaatatctacatagattcagaagcgtccaaggatgttgacaacaagtgctgtccagcctgtgaaatgctcagcaccagtaccatgaccatctatcggactgtaattttcataacaataaccttgttcttcccaaactttgtatatgttgttactgagattaatctttaaactttggtacagtttcttggcattgctagcctcaccagccacgtcgagaatcacctctgggtagtagtatctcattgcgtcaagacacaagtaattaatattcatccaaattgggcctctccaatagttttcatccttgccgaaatagtcgtcttgtctcgatagtgataacagcccgtagtctgaaaagattttttctgggtcactcatcaaagcaactactttctctagcttgggtgagtttttggggattagcttcaatgcaaagggcaatacggagacgtaaccctcatgacatacaaactccctaatctcatcgtcttctggatcgatgctaatatcacagtagcaattgtcattttcactccagtgtaacaaatccagattctcgaccacctcttgctcaatttgtgcatatctttgctcgtcctgtgttaacttcaacacgtgagcaatttgcttcatggatcttgtcataacgcccacccatgctaatgcgtctacgttcaattctgctacatctggtggttgtgctctaggatagtcatccataccgcttggcaaacaatgagtgaaggtacgcccaacccatctataaacttcgttcttatgaatcttatcccatattccttcatcttccaatatttcctcatattcatcaataagtcctgtttgagattttctgaaccaattatagtgcttcaatagcttaggataaattttcttggcatattcggttagcaagccaggattggcttctagattgttcgtcataaacttggctgtcctactattgaacatgacttggtggtagctgtcactgttgaaatcgccgatgttttcaatggccctagaaagcatttcactaaatgctagcaataaagttggcggattagcaatattgggattttgcacctgaaattcctgcggaactttactccttgcctcattacccagtataatttctctagcaatccaaccactatcatcttcgatcatttcaaaccagctcgctaagatttcaaaggcaaggtcaaaatcatactccataatttgtagaagatggaaaccttcatcccaatagaatccacgtgggaaaaagccacggctcggaacgctggtaaacagttcaaatggaccttcctcttttgcattcagcagtttgatctctgtaaactggctctcatcaaattctgtttcacgatcaattagttgattcccatagaaataaccgattcctcctaataggtttgatagcgtctctaaagcaaatcttcttttgacctccacgctttcaattgagtcgggaccttctccaaaactaaactgcttatcaaaacgcgcgtttatctcatttagtgaccaagtaatcaactccgtaacttgttccctggtggaaatactttgagtagtgccaagtttattgtaagtgatatcaaattggaacccatcttttttggtcaaatcaaatgtcttttgtatataatgaaaattaccaggattaaaattgtacaaatttctaatagttaaaacacttggtattaaatcagcaggacgctgctttgtctcttccttttccagtatatcacgtatcgaatcgctaactagagattggaaaacatcacgagccttccaaacttctttatccgggatttgaagtgataaatgacttgttttagagcagtcacttcctggtgctacttccatggtttcatattccggatttttgaagtagtgaccaaaattgtcctttactgtaagatgatactcgcctaattctttagaatatccgaagaatttcatgtcattagggccgtcatgacctatcattgctaaggaagattttccatctatctcgccaccattttgactaaagtacaatacgacagatgctgtagatggtctcttgggatccaaaggctcaccttgaactctcactgaccaattttccccgttcttgctctttacaaaataaacagtcaagttcaagttatttttttcatcaataaaaacttctttaccaccaattcttggatcatacacttcccaaccatacttttgcaatttatcctgaggcgttgcaaaatgtcttaacgaatgtaagccatcctgactcaaactgttgaaccacatgatacccataattagtggactttcatggacatatctgggcctcataccaaagtaacaattggatctatacggtgcccacagtaaagattcattcgtgaacttttgatattcttcgaattcttgtagtttactaatatcaacggtggcagatgccaggagaactatgctggttagtatccaaaatgttttaaacatcttagattttgaaataagcattgtgaagcaacctgaaccgttattatccactacttccttattaacagttgacgctaatatagtgtgtcacgcatacaataattgaacttttaaattacgcgaaaatgtggctgttctgaccgaaatgatctaaaattggtcacgatactaatcttgagcaaattgagaggtaaaagagctgaatatgctaatgtatcccgatcgtatattatattcgtctatgtagttaaaaagctaaataaaagcgttccttatcagatattactcattaggcagatgggtcttcttcgaatctcaaatcccaacctatctttggacctaatttcggcaagacttcagcgacactttggacatctttatcacctctaccagaaatattgataaccaaatgttgatcaggcttcatcgtcttagccaattcgcaagcgccataaacagcatgagaagattccaaagcgggaataataccttctaattgagataataatttaaagccaagcagagcctgagcgtcagtagctgcaatgaattgagcacggccagtagatttccaatatgccaattctggaccgacacctgggtagtctaacccagcagaaacagaatgagtatcatggacttgaccatcactatcttgcaagacataagtcttgacaccatggaagacaccaggtctaccggcagttagagtagcagagtggaactttgtatctacaccatcaccaccggcttccacacccaataacttaacggaagtatcatgctcgaatggtgaaaacatacctgtagagttggaaccacccccaacacatgcaacaactgcgtcaggtaatttaccattgttcatggcagcaaactgttccttggtttctttaccaatgacactttggaaagttctaaccaaagttggatatgggtgaggaccaatggcagaaccgacgacgtagtaagtagttttcaagttagtaacccaaaatctgaatgcctctgaagtagcgtctcttagagtctttgtaccattagtaacagcaattactttagcaccgagaattctcattctgaagacgtttaaagcttggcgacgaacatcttctgcacccatgaacacagtacaggttaagccaaatttagcacatgcagtggcagtggcaacaccgtgttgaccagcaccggtttcagcaataacgttcttcttgcctaatcttttagctagaagaacttgtgctaaagcattgttgatcttgtgagatcccgtgtggttaagatcttctctcttcaaccagatttgagcaccttgacaatgctcagttaatctctcagctttgtgtagtgaagaaggacggccaatataagaatacaaggatttgaagtcttcccagaatgtgggatcggcgacagcttcatcaaaacccttttccaactctcttagacatgcatgaagagcttctgggacatactgaccaccaaagtccccaaatctaattgggtgcttgtgattttcatcaaattcgtccagtatttccttcttaacgtttgcggacttcaaggactctttttgaaaggcaaagaattcgtccttggacagaaccttatgcttagcaccatttagaattccctgtacatattccttagcaacgtcgtaccttttgccctctggagcatctccacataatgtgacgattttggaaccaatcactacaccgtcagcaacactaccaactgattggaaatgttctctggtagagacaccaaacccaacggccaaaggagtatccttggtgtactttctgactctagagatgagttcatccaaatcactggccacagaactttgaacaccagtagtacccattctagacacaacgtagacaaacgaatcggcaatatgcgatagtaattccaatctttcgtcggtggtagaaggagccactagtgggatcaggctcaaaccattatcattgatgtagtttctgaccttcaacgcctcctctggtggcaaatcgacgatgataaaaccattagcaccagccttggcagcgtcctgaataaatctttcttcaccgtagtttagaatagggttatagtaacccattaggattatgggtacggtaacaccttcatttctagcttgggagaccatttctagagtttgaggcaaggtaacaccgttttgcaaagccacagtattagataattgaattgtaggaccatctgcaattggatcagagaagggcatacccaattcgatgatatctacaccaccatcctggaaacccttgagaatagggacagtgtctttgactgttgggtaacctgcggtcataaatgtgaccaaggcgttcctgttttcttttttagcgttagcaaatgtttgtctgagttgttctgacatggtctgtcggtgtgctatgtccctttttggagcaatcgatgtttacagtccataaaaagtgtaagaatctcgatgattcttatatgacaaatagtaaaattagtcattcttccacggtcaagaagtgaaaaaaaataaaaaataaaaagaaaagcctttcgggtaataaggtataaagaatagaagattatacagataattactatcttggatacatagatgcaccagtcacaagaaatccatgttcagaccacctaattccagattgttcaggtctagagaatccagttctttccccccgttattcatgttattcatgcccatattcatattgtactgtggttgaggctgctgctgctgctgttgctgttgctgctgctgctggaaatcgttattcatgctcatatttaggatattagcaggggttagattgtttaggtttaattgtgactgtagcggggtgttattggagtttgtatttgtatttggattggatccattgccgctgccattgaattgtgacatagatacttgtcccccttggttttgagctcccattgagtatgcgttccccatgggagacatcatgttggtcagcggcgtgcccataacatttgtgggcgaaacgctgttaatcatgctaggagttgggttgggtagcgcggctgccatcgatgctgttattggcgtctggacagtcgactgctgtgcgtagacctgcgcttgagcctgcgcttgagcctgagcttgagcctttgccttcttggtttgtcttggttttcttggctttttaggtgccgcaatcggtgcagctgcagtgctattatgtacggttggagttcccatagtactaccgctttttggacctctcttgccggccaggggattatgttgcattgtagcggtgctatttggattcgaaagcgagtgcgcatgtgtgatgggatttgcatgaggggtggcagttgtggtgggtgtcgaagcggccgcagagtggttggtgcttacaacagttgctgtcgagcaaacggcgttgccatttttgttataagtactcaacggttccaaaagctggaaacttctgtccctgttatctgcagtcttcaagtattctggtacagtgctgaataaaggttgcagtgcttctaaatgcgaagacaaagtctggaatctatcgttcagttgcaaaatcttgtctctgatatgtaggtatttggccatacggtcagcctgcttggatccttcttggtctatgtttgccattatctgtatgaattcattgaactgcaatcgcaacggcagaatttcatcgcgtgcttcgttgatctgcttacacactttgtccctggtttcattctcgttcttagccaatatcacttgtaaatcatctagcttgacgcctgccggtataatcgagtccattccggttgtctttactgctgttgtgtccgttttgcgctgcctaattgaagaagtcttggtgactgtttctgttgttctctttaaaatttcgctcggcgccataccgaaaatcctcaggaaagtgttagtgttatatattatattatattatatcatattatattaagtttattgtatacataatggtcatacatcaatagtgtacatcctctcttcgcttgtctcgcaaaaaatgttcatcagaaactactccaattccagtttgcaggcacagagccgataacactgcccaaaacatcattaccttcttcttgttctccccccgtattctcattatctgcttcttcgtcgttcgacttcacctggatgggcgttgttgtgtctcgatcaaccgtggcatgctcttgggacgaaccgcccttctttggtctgaaaagagcgttcatctgcctattcttgtagtaattgcgtaatttcttcctattgtcattatcgtcatcttcgccctcctcaacgtttatgttatcctcgttcgtgtttgcgttatggttcgtggttgaaaggttctcgtactcgaccagacagtcatcgcatattttacagagagtgccaccgccatttatgccaccgttgtttagttcgttgatcattataaaatttgcctgcgagtccaggtacagccaatggcgcaaatggtcttgacaaaagatgtccccgcaatgcctgcaatgatgtttcctttcccacagggtaaaaggcttatggcagtaacgacaagaattcctcttactgtccggaatccagtggtccttagtgggcgggtttactctggcagagtttctgtttgaaatagttggtattaagttgattctgtcgctgttcggaatagaattcgggaacaagtacgaggatattttgtttttgtagctttccaagattgacgatgtgttggattgtacgctggattgagaagatatgatccgtaggttgttcgcattctgaacgctagcggattgcgacttgcttggattaaagccatgttccaggttagatgccttcttgtagtaagacgacaatgttgcattcaacagatcgtcattagttatgtttgtctctgaaactttcctcagcacggcggggatgtatagcggttttttagggttactgatctgtcttacatttgatttatgtttattggaattaaaattcagattagtgctcgaagcaggctgcggtaaaaattccagcgagggtttccttagcatctgctgatgcggcggtttcgccgcatgattcaccgaatcaataatgacgttcgtgttgccaaaccgcagttgggacatcgagctagaattcgttgtagtcagcttgtcgacaatattttccaccttcgacgtcgacgatgacgacactgaagacgtggacgaagatgaagactctttcgccttgttttctttactcaacctcaaattagaactagcattcattttgaacgacgacaacttgcgtaacgcctgcgtggttagattcttttgtcgaacctcgtcatcgtcatcggcatcatcttctaactcattgaacacagttttgctctttgtattcttgcccctgctaacatccaccacgctattggtgggatctagttcagggttcgatctttggtcatccgtgaatggcaacgtcttgccgatctccttactagcagaagccttcctaccatctatctgcccttcaccgagcttgctactgtggctgctgcgaacattctcctcagcagagttcttcctcaatatggacaccatcgccggagattggatctgctgctttctgtcaacaaacccagtgcctgcccctgttgagctctcttgctgcaactgctgctgacgatgttgatttaccatcgatttcaatgagatgctgctcaaaatactctgttcggaatgcgttgacgccctgggcgctatcttcttcttttcaaacgtgatgggagatgtcacggtgtcagcaccgctttcctcatcacctttcctgccacggtagtcatggttccttggtcccaggggaactcctctgccgtctcgctcatcaccgtcctcctcctcttccttgatcgcgggcgttttggacacactatgcaacgcagtcattctggtctccactacaactgtgctgcccagtcctcctcactggcgcttcgtacctattccaggtctcaatagtcatatcataagctttcttttacttctcttcgcctctgctaaatggtcaccatcgacggttgctttttcgcgctggtcgagaattgacaaaataagacacgaacaaaagagcaagtctgaaagaaagaaaagcagcaaaagcacggtctaattcaacgtgacatagcatccgcaatcgcattcacagccgtaaatcctaactaccattcgtcattatcacagctgccatgggatccgaccggtcgtgtgttttgtctgtgtttcagaccatcctcaagctcgtcatcttcgtggcgatttttggggctgccatatcatcacgtttgtttgcagtcatcaaatttgagtctattatccatgaattcgacccctggttcaattatagggctaccaaatatctcgtcaacaattcgttttacaagtttttgaactggtttgacgaccgtacctggtaccccctcggaagggttactggagggactttatatcctggtttgatgacgactagtgcgttcatctggcacgccctgcgcaactggttgggcttgcccattgacatcagaaacgtttgtgtgctatttgcgccactattttctggggtcaccgcctgggcgacttacgaatttacgaaagagattaaagatgccagcgctgggcttttggctgctggttttatagccattgtccccggttatatatctagatcagtggcggggtcctacgataatgaggccattgccattacactattaatggtcactttcatgttttggattaaggcccaaaagactggctctatcatgcacgcaacgtgtgcagctttattctacttctacatggtgtcggcttggggtggatacgtgttcatcaccaacttgatcccactccatgtctttttgctgattttgatgggcagatattcgtccaaactgtattctgcctacaccacttggtacgctattggaactgttgcatccatgcagatcccatttgtcggtttcctacctatcaggtctaacgaccacatggccgcattgggtgttttcggtttgattcagattgtcgccttcggtgacttcgtgaagggccaaatcagcacagctaagtttaaagtcatcatgatggtttctctgtttttgatcttggtccttggtgtggtcggactttctgccttgacctatatggggttgattgccccttggactggtagattttattcgttatgggataccaactacgcaaagatccacattcctatcattgcctccgtttccgaacatcaacccgtttcgtggcccgctttcttctttgatacccactttttgatctggctattccccgccggtgtattcctactattcctcgacttgaaagacgagcacgtttttgtcatcgcttactccgttctgtgttcgtactttgccggtgttatggttagattgatgttgactttgacaccagtcatctgtgtgtccgccgccgtcgcattgtccaagatatttgacatctacctggatttcaagacaagtgaccgcaaatacgccatcaaacctgcggcactactggccaaattgattgtttccggatcattcatcttttatttgtatcttttcgtcttccattctacttgggtaacaagaactgcatactcttctccttctgttgttttgccatcacaaaccccagatggtaaattggcgttgatcgacgacttcagggaagcgtactattggttaagaatgaactctgatgaggacagtaaggttgcagcgtggtgggattacggttaccaaattggtggcatggcagacagaaccactttagtcgataacaacacgtggaacaatactcacatcgccatcgttggtaaagccatggcttcccctgaagagaaatcttacgaaattctaaaagagcatgatgtcgattatgtcttggtcatctttggtggtctaattgggtttggtggtgatgacatcaacaaattcttgtggatgatcagaattagcgagggaatctggccagaagagataaaagagcgtgatttctataccgcagagggagaatacagagtagatgcaagggcttctgagaccatgaggaactcgctactttacaagatgtcctacaaagatttcccacaattattcaatggtggccaagccactgacagagtgcgtcaacaaatgatcacaccattagacgtcccaccattagactacttcgacgaagtttttacttccgaaaactggatggttagaatatatcaattgaagaaggatgatgcccaaggtagaactttgagggacgttggtgagttaaccaggtcttctacgaaaaccagaaggtccataaagagacctgaattaggcttgagagtctaaattggccacacattaaaggaaatgactaagataaaatatacatatataaaaagataaacaaataagtataagtttggtttcccttcccgttattatgatcgctcgtgacggatcgtctttgccctttttggtaaaacgtaaacaaaataacaatagaaaaaataacaactttatcaatgtttatttttatttattaagtatttgatgtgaagtagtttttctaaatgctacttcattttgacattgtaattcaattactatcaagtcatacccttaaatcgcaccaagtagagccccccatggattttgaaacgtcgttcgaagaatttgtcgaagataaacgattcattgctctagaggtatctgataatgatgacgattgtgacactgatttgactgctgacacagctgacgagctggaaagctctgctatcttaaagatgagggagtctgatgcatctttaaatgttaccaccggcaataatacatcaaggaaaacgacttccaattccaaaaaacgatggtctctattatccaatcattctgctgtttcatcatctaaatctaagaaaagatggtctgtactttcttcaagctttaccagtgaatctcataaggacagggaatcgaggaacgttttgcaacaaaaaagaaaatccttgcagagttattcaagcttagatacggtagcatctaatagctctatctctgcttcttcttctttgaaaagatcgtccactggtctttccctcagacaattgtttaccaagataggcataaacgatgatatatcacaacctgggatcgggattccgcaaggtaaggaaaatctgcctccaactatgggcaaaaaaaattcatcaattgcttccactagttcggaaaacagacttaggacaccattgaagccgcttgttaatcattctaaaaggcccacttcacaaccacaacagcaacaaccactatataatgcatcattgtcctcgagaagatcgtcgatttcttccactgtctcttcttccagctcgtctaaatggagattctggaagagaaataagaaccagacacctgcattgttgcaaccagaccaccattctttaaaaacctttcctgcagtaaaccgtcgtgattccatgacgcccgttgaaccaagaaatatggtaaaacataagacatccttttcagatttccataagactatcttcagttcaaatacgtattctgaaagcagcgatacaatatcttccatggaaattactttgaaaaacaaagcttcttcctcaagtctatctttgaacgtgttgaagaaaaggaattcgcaatcaagtttgaagcacaaaagttcacatgcatccttacaaaaattcaaaagaaacaaaggaaagtcctccatgatagcaccatcgacagcaactaatagcagcaatgatgactcttgtagctacagttccaaaaattctacgttgagtcaccgaatatcgttacctgtaccggaccaagtttcccgtgataaaattcagaacaaattaagatattcgacctcattactctcattaaattctaaatcatctttaccgatgaacaaaaatgatcatgatgagacacttctaagacagattttactaaattgtgatataaagagaattttaaaccccgcaaaaggagatgtattgcctttaatcaacgatgtaaaccatttgtcatcaatacaattaacatcaaatgtttggcaaattggtgaagtaatctgtaaaaaagtttctctcggtactattgatgacattacatgggatagaaagttcttatctttgcaggaactggaaaaactcaaaatcatgcaacaaaaatttgatggcataccgcaactattgaaaagttttgttgttaaagaggcaaatggggggttgtatttgtacttactattcaaagatcacggtaccccaatttcgttaatctcactgaaaaactggaagcagattctaaagattttttggtcttgtgctggtataattcatgggttggaaaaaaatttgaaatttgaacatcgtaatcttactttggataatattttgatagatggtaatgggaatataacaattattgattttaaatgcagtagattgcaaactcctcaagatgatgttttatatctacggctagatcatccactcttttttctaaatgggaaagacaagagtaaaataaacgaataccagtatcaatttgagtttgaaatctatcaaagtatgcggatcttgttgaacatggacgcgtcagcttttgagcccatgacaaatttgtattggttatattacctgtcacgcgttttactaaagtttggtgacaggaagcttggtaagaatgatgcaaacagggataaaatggcaagggtgataaaccatttggaaatgaacttggcagttcataaaagaggggggcagttattcaaaagattggagacggaggacattaagaatactggagatttactaaaactttataaataaaacaaataggaatgttgacatttatatttcattttctttctattgtatactccaatacataaacatattatatatacgtacataatgtaataacactaatctaaaataatggcatcgtcgacagcatccaaggctttctcctcttgagtctccacagatgcaggtgcttccattttgggagtcaaaaacaattgcttaacgataaattccacgccgttgatgacattcatcaatgcccaaacccagattcccaaagagacactctgtaaagccatatcatcaaacttggaagcaccaaatttgccctccattatatgccatttctgagaaatagtccttagaggatgcaagagaacatataaccagccttgagaccaaacaccacttacaaacgtagggaacaaggtgctagtcgaggaactcaacttgtaaactggtgtcttgccgtacataatcttaaacacaaaaaatggcaccgtcaatgccaataacctgagtttgtgaagatgggcctgaaaggctttattttctgattgtatttcgtccttcaagttatttatttctttatctaacgagtccaattttctattgttcttagtccatttggcataattatcctgcgcggagatagagttgttgaattcttttaattcgtgacgttctttgaccttggctaagtattttttggataattcatttcctggtgcaaatttagagatccatttctcgtggtatttgtttgtatactgtagaaactttgtgaccacaataaagaatatcgctaccgctgctgcccaatgcatttctcctatttcaatcaactagacgtagttcaaggattgcaaactgtcctgctttcttttatctggtctttttatcccgaggtattgttgtatataccactactctgtgattttttttcactcttgggaaggaaagaaaaagtgaaaacatcaactggtaagtgtctaatgacaaaaacaggaggtagttggtacgtgcaaaacacgatagtgacgttaatccgaatctgtaaattggtgaattggtatttagaagcgaccattagctaaaagagagagaaaactatgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaacccttgatttattttcctctttgccctaccatatacatatgtactttacctatttacattgtttcagtttttatatcaccactattattattattactattaccactttggagtactttagtgattcatttccaattgttttcctggagcccagtctttgaatgccttggccaagttgtaccagtactttagctccacggtcaacttcactgcggcggcgtaatccttgtcattgtagcattgtcccaactgggcttcaatatcttgaattctttccttgttttgcttttcaagcagcttcacaccagcttcgtcgtccatctgggataattcatcatggatgtctagaactttcaatagtaactgtggatcactggtagttacttcatttgaggtctgttcttgcgtcaaatcgatattgcgcaagagttttagcatatattgtgaccttctaaggggatctttgagagtatggtaagcttgattaagagttgatgactgttcactaccttgttgggccatgtctggatggtgctgtgcttgtaattgcctatactccttccttaatctggattgatcgatagtccaaatgggtagctttttggggaaggtctttgggaacagctcataaaatgtagaagtgaatcttcgttgaaccaagtatttcaacattgtgcttgtggggcttcttgatacctgtttccattatcagcctcagcctttaatttcgcatcatctttttagtttccttttctttttcgttttttttttacctattgttaagaattacgctgtgagtttcattgctattgttacaaaagacaagatagtctcaagatacaactgagaagaagcacaattatgtccgatagattcgttatttgggctccctcgatgcacaatgaacctgccgcaaagtgtgggtattgtcacggtaataaggggggcaacatggatcagttgttcgcattggattcgtgggctcatcgttatatgaacaaaatggacgttgtaaagattgaaaactgcacaattggctctttcgtggaacatatggatgtagccacgtatgatcgcatgtgtaatatgggatttagaaggtctggtaagtttctttataaagtggacccgttgaggaattgttgtaggttatacaccattcgaactgcccctcaagaattgaatatgacaaaggaattgaaaaaatgcatcagccgctttgctagtagaataacaagtgaggactactgcccagccgctgttgcaagcagtgattttgtgggcaaaattgttaatgcagagatgaattctaaaacattctatacccgatttgagcccgcactttatagtgaagaaaagtatcacttatttgtcaaatatcaggaaaaagtgcatcaagactacaataattcgccgaagtcctttaagcgattcctatgtgatacgccctttggccctgaagcggtgttggggacacaagaatcatgggagcagttaaacaattggcagcgaatgaagccaggcgagaaactgaagcatatgggtcctgtgcacgaatgctactactatgagggtaaattaattgccatcactgtgtcagatatcttgcccagtggtatatcttcggtatattttatttgggatccagactacagtaaatggtccctagggaagctcagtgctttgcgcgatcttgccatcattcaaaggacaaatctgcaatactattacctggggtactatattgaggactgtccgaagatgaattataaagcaaactatggtgcggaagtactggatgtgtgtcacagtaaatatatcccattgaaacccattcaggatatgatttctaggggcaaactctttgtcataggtgaagaagagacgaaagttactaaggagctctacctcgttgactctgaaaccggaagaggggagggatttcccactgataatgttgtcaagtacaagaatattgctgaggaaatatacggtgtgggagggtgtgcgtttaaatctgcaaatgaatctgcattggaattgaaagaactttacggtataccgtacgaagaggaagatttagataccatctaccatttgaaagaacacaatggccatgctccaaatggtattcctaatgtggtgccgggattactcccgctatgggaattgctggacattatgcaatctggcaagatcactgacctggagggaagactatttctcttcgaaatcgaaacggaggggattcgaccattaattaacttttatagcgaacctccgaatgtcaagaaacgtatttgtgacgtgatacggttatttggcttcgaaacttgtatgaaagccgtcattttatatagtgagcaaatgtgagccttcaacacactattctaataacaatcctaatgtataacattttttagcattcaaacattctcaccatcgcgctgagataattttatatagttgatggaatagttttggaggtgatttatccattaaatacctgatgcttttttgtctcctcatcgcgtgaaaaatttgagaaaaagctcgaactatttgtagcacttcactgtattgctaacagttcttaaaaacttcagaacatatagatattgctaaacacagatttgaataccatagtaactagtctcttattcttagtttttgatgagctccattcacgaggttgtggctcttattgaagagctgtactctcctcatccgaaacatgatgttaatcagattcaacagagtttacagtcaatccagaaatcagagcaaggcttccacctagctaatgagcttttatctgatgacaagtactctgcgaatgtcaagtactttggtgcactgactttaactgtgcaactaaatacgcggggtgaaaacgattatgaaaccctatggaatgttttcaggtcaaatttattgtacttgacgaaattcagtacattgtacgtttccaatcctaatatgtacgggcaatctctaatcataattaaaaagttaatgtcaaacttgtcattgatcttcactaaaatcaacgatccgcagcttaataacgctggaaatgaaaatatgattaagcaatggaacaatcccataaatacgtttattcaacttatgtcggttcaaaatcaaaacattaatgcagaccaactgttgcttgactcaatcaactgctccttaacatacgagcaactgtctcaatttgttagcctatctcagaaacataatgaactggcattgacgtttacagaagttattgtggaagatttgacgaagttccaaacaaagaggcattcaatgtctcaaatccacgaagtagtccatgagcatttatatatttcaactatggctttgatcaacttgaacttaactgcacaagctgtcttcaatcctaccgtatttgattgtattactgcttggattaattatatctcattaaccagaagcgtatcttcaagtggtagaatggatttgtcggaaatttttcaaaacctgattgacttgatgtatcagtctacagaaggatcggacggttatgagaatgcggaaaagatcctaacaatatttggtaatgtttttgctaatgatccattattaatgagttacgatttgagacaacaaatcgagtgtattttcttaggtgtagtaaggcctgattctggcataaccgacatatctaacaaaaattcttggatgctacaatatatgaattatttagttaccaatgattttttttccgaattgaaggaattggccatttgtattgtggatttcttgcaaattaacacgttaagtgtttgtaataaattatttactaacattcaagcagctgataatggtcaagttcaagatgaatatattcaggaatacatcaaagtccttttgcaaatgaccaatttccctttaactcctgtcttacaagagttcttttctgttagaatggttgatttttggttggatttatcggatgcttacactaatttggctagcgaaactttgaggccaaattctattgagctgtctacacaaatttttcagcagttgatcaatatttatttacccaaaatttctttgagtgtgaaacaaagaataattgaagaagagggtgagagcacttctgtgaacgaatttgaagattttagaaacgctgtcagtgaccttgctcaatctctctggtctattttgggaaacgataatttaacaaatgtgctaattgatggtatgggccaaatgcctgctgcgagtgatgagactctcatcatcaaggatactgatgttttgtttcgaattgaaacgatgtgttttgttttgaatactatattggttgatatgactctatcagaaagcccatggattaaaaatatcgttgatgccaacaaattcttcaaccaaaatgtcatatccgtcttccaaactggtttccaaactagtgccagtacaaaagtcagtcaaattttgaaacttgacttcgtaagaacaagtacaactttaatcggcactttggctggttattttaaacaggaaccttttcaattaaacccatacgtggaagctttatttcaaggtttgcacacttgcaccaattttactagtaaaaacgaacaagaaaaaatttcgaacgataaacttgaagttatggttatcaagactgtttcaacattatgtgagacatgccgtgaggagttgactccatatttgatgcattttataagctttttaaacacagtcattatgccagactccaatgtttcacatttcactagaactaaattggttagatctataggttatgtcgttcaatgtcaagtctccaacggtccagaggagcaagctaaatatattttacaattgacgaacctattgagcggctcaatagagcattgtttggcttcatcggtacagttacaagaacaacaagattatattaattgtctattatactgtatatctgagctagcaacaagtttgatccaacctactgaaatcatcgaaaatgatgcattactacaaaggttatctgagtttcaaagtttctggtccagcgatcccttacaaatccgatcgaaaattatgtgcaccattgataaggtcttggataattcaatatattgtaaaaactccgcctttgtggagatcggttgtttgattgttggtaaaggattaaatctgcccgacggggaaccgtacttcctcaagtacaatatgtctgaagttatgaattttgttttgcggcatgtccccaactgtgagcttgctacttgcttgccttattttgtttatttattagaaaagcttatttcagagttcaggaaggaactaacaccacaagaatttgatttcatgtttgaaaagatccttctagtctattatgatgcatatattatcaatgatccggaccttttacaaatgacaataggttttgttaataacgttttggacgtgaagccaggcttagctattggcagtaaacattggacatcatttattttacctcaatttttaaaattaataccttcaagagaaaagttcacaattgttgcggtggcaaaattttggactaagttgatcaataataagaaatacaaccaagaagaactcacaactgttaggcaacaagtttcctctataggaggagaccttgtgtaccaaattatgtatggcttattccacacacaaaggtccgatctgaatagttacacagatctgctaagagctttggtagccaagtttccaattgaagcaagagagtggctcgttgctgttttgccccaaatatgtaacaatcctgcaggtcatgaaaaatttattaataaattacttattacgagaggaagcagagcagctggaaatgttattttgcagtggtggttggattgtaccacacttccaaattaccaaggatgatttgttaagaatttctccgctgagggtgaaggctattctttgttacattttatttagtaatgcgttgatcctttttgatagattttttttttgtgctttaaagatagtagcagtatatatgtgtgtaaaagctaatcatcagaagtgcagcattcattgctagtatttagtgataaaaattttagaatttccatttctaattgtaattgcttttcattccaatacatgtttgagcttctggggggtaaaaatacatttccagacagggcgtcaggttgaaagcagttactgaaacatagagagtcgacgtcaggaggaggcttcaaatggttttctgaaagtgattcggtcttatttttccattttctaaaatggtgaatcctttctctggaaatgtgtgatccctttgccttttgtgaaaacttttttaacgagctttttaggttattagttgtctcaagaaggtttatgggcccgctggtctcgatatctgcgtaatttaatggacgtatcgtgtcttccatggagtgaattgtgatttgtgaattatatctgtccaataccgttgccttgttgggagctcagatagaaaagacatcttaattccagacagtctattctctgtctatttctctttgtgactgcaaattttaatttgtgacgccttttcttattactcatgtatttgtcactcttgacgattgttttttttctatattttttttgttctggggtcctccagagaataaaaaataatgatcaatatagtagatagtatagttatattcttattcgttgcaccttgtttaacaaatcactcagactcaaagagaatatcggttggttatctctctccgaaggtgaacagcaaacagtacctcacgtcttttttttgaatagttttttttttgttgaaacagaaaaaaaactttcttccgtatattacattgtacattatttttattgtattttagtttccaacgttaggatttgagccgtcattaatattattcgtttttgtacactattccagacgatttatttttagtacacttaaaattcctgttgatattgtccactagttctcttttcatattttattttcgcttattctttaggttcttttaagagtctctgttcattttccgttcttactgtttctttgtcctcgatatcttttaagaaagagagaactaagcgctgtaacatttttaagtggacctacgttatgtctacaaaaggtttgaaagaagaaatcgatgatgtaccatcagtagaccctgtcgtttcagaaacagtcaattctgctttagagcagttgcaactagatgatccagaggaaaacgccacctctaatgcatttgcgaataaagtttctcaagattctcaattcgctaatggccctccgtcgcaaatgtttccacatccacaaatgatgggtggaatgggcttcatgccctactctcaaatgatgcaggttcctcataatccttgtccattttttccgccccctgattttaatgatccaacagcaccattgagtagctcgcccttgaatgcaggcggtccaccaatgttattcaagaatgactcacttccatttcaaatgctgtcttcgggtgctgcggtagcaactcaaggtggacaaaatctaaacccattgataaatgacaattcaatgaaggtattgccaatcgcatcggctgatccgttatggactcattcaaacgtaccaggatcagcatctgtagccattgaagaaaccaccgctactctacaagaaagcctaccatctaagggcagggagtctaataataaggctagttcgttcagaagacaaacttttcatgctttatcaccaactgaccttatcaatgcggccaacaatgtaaccttgtcaaaggacttccaatctgacatgcagaatttttctaaggctaagaaaccgtctgtaggagctaacaatactgcaaaaaccagaactcaatccatatcttttgataatactccctcctcaacgtcatttatacccccaaccaatagtgtttctgagaaattatccgatttcaaaatagaaacctcgaaggaggatttgattaataaaactgcaccagctaaaaaagagagtcctacaacttatggtgcagcatatccatatgggggacctttacttcaaccaaatcctattatgccaggccacccacataatatatcctcccctatctatggtattagatcaccttttcctaattcttatgaaatgggcgcgcaatttcaacctttctctccgattttaaatcctacgagtcattcactaaatgcaaattctccaattcctctaacccaatcgccaattcatcttgcaccagttttaaaccctagttcaaattctgttgccttttcagatatgaagaatgatggtggtaagcccaccaccgataacgacaaggcgggtccaaatgttaggatggatttaataaatcctaatcttgggccatcaatgcaacctttccacatattacctccccagcaaaacaccccccctcctccctggctttatagcactccacctcccttcaacgcaatggttccgcctcatttgttggctcaaaatcatatgccgttaatgaatagcgccaataataaacatcatggtcgtaataacaatagcatgtcaagtcataatgacaatgacaacattggtaattctaattacaacaataaagacacaggtcgttctaacgttggtaaaatgaaaaatatgaaaaacagttatcatggctactataataacaataataataataataataataacaataataataataacagtaatgctaccaacagcaacagcgcggaaaaacaacgtaaaattgaggagtcgtcgagatttgcggacgcagttttagaccaatatatcggaagtattcactcattgtgtaaagaccaacatggttgtcgttttctgcaaaagcagttggatattctcggcagtaaggcggcggacgcaatttttgaagaaactaaggattatacggttgaattgatgactgattcattcggtaattatttgatccagaagctattggaagaggttaccacagaacaaagaatcgtactcacaaaaatatcttcccctcattttgtcgaaatttccttaaaccctcatggtactagggcattacaaaaactcattgaatgcatcaaaacagatgaagaagcacagattgttgttgattctttacgcccttatactgtccagttgagtaaggatttaaatggtaatcatgttattcaaaaatgtttgcaaaggttgaagcctgaaaacttccagtttatctttgacgcaatctctgatagctgtattgatattgctactcatagacacgggtgttgcgttttgcaacgttgtctagatcatgggactacagaacaatgtgacaatctgtgtgataagttgctagcccttgttgataaattaactttggatccatttggcaactatgtggtgcaatatataattaccaaagaggctgagaagaacaaatatgattatacgcataaaattgtccacctgttgaaaccaagagccatcgaactttctatccataaatttggatcaaatgtgattgaaaaaatcttgaagacagctattgtttcggagccaatgattctggaaattttaaataatggtggcgagacgggtattcaatcattgttgaatgatagctacggaaattacgttttacagacagcattagacatttctcataagcaaaatgactatctctataaaagactatcagagattgtggcgcctttactggtgggccccataagaaatacacctcatggtaaaagaatcatcggaatgttacatttagattcatagttgatacatatatcctcagtttagctttttttacgttagcctcatataatatcttttgtacaatactaaaatacatcattttttttttcgttgaggatcaaatgaatatccaaagcaaaaaaaataggaattttcactttatggtatactggtaaatagtgttgaagaaataagagaaggagatgccctagaaaacagaatgttcttatttaaataagtaaactcaaaagaaaaaaaaaaggaaggaagtttttgagaacttttatctatacaaacgtatacgtttaactatctggataaacgtcgctccacaggatactgtagaggtcctcaagatcaccgttattaacaaattcatctagtgtccccaaattaaaactagttgcagaaaaattgttactgttgttgttgttaatattgttaatattgtttttattgttgttgttgttgatttcatttgtgttcataaatggtacttgtactgaagtgggtatttgctgctgagcattgattggtttattagattggacttgcgtattattttgcccatttgttggttgcgcgtaatcgggattgatcatatcagacacggataatgacctaaatgaaggcaattgtgcaaactccggtagtgagttgtttctcactggggaaggtgctgagcgaccattgaatggcaattgaggcgattcaatgccatttagtaagcatgaaatgcccgtcttaagacttgggagatccggattcaaattttttcccgaattatgcttcatctgcttattatcttcatttgacattagtggttcctgaaactttctatttttcaacatttgtgagaccgttaaatggaatcctgacttctgaacaggttctaataaaaatcgataagcgcaagagtttgtatccaagacaagttctattataccttttaaatctggcgcattctcatcaatatatttggagataacatcgaggttggtgctagaggactctccgtatgccaaaagcatgatacgagcgacgattgtcaggaaagaaaaagctcttgtatagtctttaaagctttggctgttgaagacatgctcattggtctcattttcggaaaaaatttttatatccaaaaatcttttgaagactctaatcatattcacaacgtcatttactttaatgaattcggccactgagaatgcttgtgataccaaaataatgcaactgatagaataatgggcgaacgaacggtatacggaataatcgttgtcaaagtctaataagattttgttcatatcggtccatgatttgtaaatcttgtgaaggtatattttcaagttttcaattagtattgagggccttctgtgcacgcataatctggcgacaatattatcagattcgttaaccattctgcagaaatggtgctcgtaaaatagaacaaattttgaagccataatcttatcctctcttgaaactttgagttcagtactatctttagagaatgcgatatcgaacaattttccagtttgctctttgatagcatcatatttcatttctgtttcgttaaaaatctcgagtacctcgaagagtagtttctctctaacaacagatggttttgatgtattcctaattgacgtgaatttttcattgaataaaacagatgatgagaaatggctgactatttgtaagacagctaattcgccatagtattttaagtcggatatgcacatgttgtcaaaagcttcgctcctgcgaactaagtggacgttctcgataaaatctctattgtccaagaacccaacatctcgaaaattcttaggtaataaacaattgattttggagtcatcaatgttcgaaggatagccaagtttagaggctaaagttttctcgaaatagaaagctttccaccagagatttcttcttctttcagcaaagttttcatcaagacccacgtaaaattcccaccttgataaaccaactcttgaaacaaaatgaactgctacgttcaagactttttcaaaaccgtatatttccgatagccaaaatagcagatccaaaaagtatagaagttgctctaaatgcgttatgtcgcatgtgaagtccacgtagttgtataatgtagaattataatagctgtaacataaggcgattagcgcctctccagcttgacaataatggatgaattcctgcaagacatcaattgactgcgtgtttttagccacggaggggttagatgtgatttccattaggaagttcttgtaggaatttttatgcatatccaacatcttcaataaaatgccaaacatgctgatatcattattcatttcgcttagtagctcagaattacttattccggttatatttctcacaaagggctgcggtaagtgatttatcactaacgcaacatgcgattttgtgtgtgctgtattcgggctccctgcagatgatatcgaagatggggttgaaggtaaaagattcattttctgtaggtagttttccaggggattagctatggagacacagccttggttgatgtgatgaaaacaaacgtcgaaaaaccttaacatgatgtatatggtttccttggcggtcctgggaaaaatctcgcatttggatttggatctataattttggaaacatttaccaataccttgaagtgacaaaaattggaaaggagagtacaaaccaaagatttcgtcgatcaaaggttgactagaagtatcttggtccttcttattgtttgaccaagcggcatatcttgtcaaatgtaccacatcacagtatttgtttttcatcaattgagtttctattgatttattagggtaaaatttcgttgttgctaattctttggtcctcactttgggttcccatcgcttaagcaagtcacttatctgaagttcaatgctctcgatggctgaggttacatgtgtacctaaatgagccatctccttcaaatttttcagagtggtttgtagagatgtcaaagttgcctgtgattcgctatcgtcttcataaaaaccgtttctattcacatcgtcgtcattcttcccatcacttccgctattatcaccactactacgaccacctagcttgaaattctcaaaaaatttcgttggttgttccactgcgcatggcccgtctgtacatcgctgaggattagaaaaagaagtcgaactggaatctgtttcctctttgacttgtacggttgtaccttccaaactcgtcttgtgaaggttttttattcgagcgccaccttgtctagtgctgaacgtgcactcacatgaatatatctcacagcttgcgcagggaaacttcccattacattttatctttctttttctacagttatcgcacgctttacttactttcgaccttggcttacgaatcttgccgctgaaacctgtagaaaagttgctggagtccgcggacgattctgtatccggacccgtctcaatatgtacaccgttcttaggtgtcaagcctcgcatcttccagtttcttggattcttttctgtatattcttggctgagatgaatagttagcaagtgatgtgcaaattgtctttttttagccaaaactcactcctggtaatgtctatatggccgctatggtcctgctatcatgctattgttgacaatgaaagagtggctgatcatgtgtaataggcgaataaggttgttttgaagagctttaattagcgcctcttattgccactcattaggtcttgaacaagaaaagaaactccatttagggtatgcgtctgtttccaacaaagccctattggaccctgagaatgtaaatcagggctcgtttcttctcgtttaataactaaacgagactcatttctttttcgttccttggcgctattttcgtgcatcccgtaattgccggtattacgcgatcgtttggcgttactatggaaaagcagaattatatatcctcgaggaaaaattaccaaacagtggtaataacgtaggaatgtagttcagttatgtagataggcagatacggatatttacgtagtgtacatagattagcatcgctatggcaaaggataatagtgagaagctgcaggtgcagggagaggagaaaaagtccaagcaaccggttaatttcctgcctcagggtaaatggctgaagccaaatgaaatcgaatatgagtttggtgggactactggtgttattggtatgctgatcgggtttccactgctaatgtactatatgtggatttgtgcggaattttatcacggtaaggttgccctacccaaggctggtgaatcgtggatgcactttatcaagcacctataccagttagtcttggagaacggtatcccagaaaagtatgactggactattttcttaacattttgggtgtttcagatcattttctactatacgttgcccgggatttggacaaaaggtcaaccattgtctcatttgaagggaaaacaattgccttacttttgtaatgccatgtggaccttgtatgtaactaccactttggtcttggttttgcactttaccaatctttttagattgtatgtcattattgaccgttttgggaggatcatgacatgtgccattatttcagggtttgccttctccatcatattgtacttatggactttatttatctcacatgactatcatagaatgacaggaaaccatctatatgatttcttcatgggagctccactaaaccctaggtgggggattttggacttgaagatgtttttcgaggttagattaccttggttcaccctttactttatcactttgggtgcctgtttgaagcagtgggagacttacggctatgtgacaccacaattgggggttgtcatgttagctcattggttgtacgcgaacgcatgtgctaaaggtgaagaattgattgttccaacctgggacatggcttacgaaaagtttggatttatgctgatcttctggaatattgccggtgtcccatacacttactgtcattgtacgttgtatttgtactaccatgacccatctgaatatcactggtctacactgtacaatgtttcgctgtacgttgttctattatgcgcctactacttctttgacacggcaaatgctcagaaaaatgccttcagaaagcaaatgtctggtgacaagacaggtaggaagactttcccatttttgccataccaaattttgaagaatccaaagtatatggttacctccaatggatcgtacctattgattgatggttggtacactttggctagaaaaattcactacactgccgattggactcaatctctcgtttgggccttgtcttgcgggttcaactcggtgttcccatggtttttcccagtattcttccttgttgtcctgattcacagagccttcagagaccaagcaaaatgtaagagaaagtacggaaaagattgggatgagtattgtaaacattgcccttacgtctttattccttatgttttctagttattttctttttctatccacttcattaacttattttacagtttgtatataaaagtattgatgtatttacgcgacaaaagggcttgaaaagattcgattttctattacttgatctactttttcctataaaataaatcctaaatgaaacgtgtccatacatatattgagtgttgacgcgtgtgatttcacattatgttgtggcaggaagtatgttaatcttgttcagcaattgctactagcctttcttcgatgttctcagcactcaaggtaaagaatttgtcctttgtagcgacaccgacttccaagtcattctttgaaaattcggtacccagtgcgtcaatcatatgagtaatagcaaattctaccaccttctcccatgattcttcattaatatggtcgattttactctttttgaaatggttttctaagtttgttgtgatctcctgttgttttggtcctgtcgcagtagctttgtagccaacgtaataacctgcagggtcagttttgtaaatggagggacccaattcttcatctaccgaaacaaatgtgagtataacacctaatggtctcatatatgctctttgagtatagatttgggaaaggttagccattctcttagccaatacatcgcatggcatatcataaccatatttataacggaattctgcagcctcagccttggctcttagggccgcatttcttgcatccggtattggtccgttcactaccataccaattgttcttgaaatacaaaaaatatacgaaacagtagttggatccaacagtttatcagggacctttttctgacttatcaccactgtacaatctttacctctgaccgctagtgagtttatgttagtttgattagtcgctttaaaggcatattctacttgatataaacgaccctcgggggaaaagatagtgatgtgcctgtcataaccagcagcagatgcagcagcagcacccgacatgattgtaatatgtttttttcgctttgcttcgtctctgcccttatatgatttagcatgaagattataatgagttagccatttaacttactctatccttacggtggcaaattggtgtgtgcccttcgtctattgtgatatcataattaaggatcgcgattaccattataagaggatggggaaaaggaatgccaaggtaaatccaggaaagtgaaacttgggagtttgtttggaggatatgtatataaatatacgaggttttgagaatatagtctcttcttctgttataaaagaataaatatgggcgaaggtttgctggatttaagatctcagcttggattttacaagttttaccaccacaatcctaagaacgttttgatccattccatatttgtccccacaatcctatttagtggtagctgtatgctccacagagtcaaaatatatcagagtatttcattgactgctgtgctaagcgttttattttccatattttattgtcttctgtatttacccacagggctattagcaggagttctcttgcttttgttaaatcttgcactcatcgatcacagggttgatttaacatttaagcaggaactgggtttgtttactattggttggattttccaatttgttggccatggtgtctttgagaaaaggaggccagcgttaattgacaatctagttcagagcttggtgctggcaccatattttataatgttcgagttccttttcaaattgggtttcatgcctagattaaaggcaactctcgaacatgatcttgaaattaagcaaagaaatttgcggatgcaaagacaataaagagggataatgttgcatttaaagtacatgttcctctgtagcattcacaaaacctgcatgcattaacaagggctagcattataaacttcatcaatgatgttatagtcaaataaataaataattagtgagtacgttagattacgtattaataataaataagtagtttggttttagaaaaggatggtgtgcttgtcgctgagacacatgttattgacgccaggtttggacgttgtttttcactgtctaccaatcctggtggactttatcgaaagtagttgtaacagcttttctttttggaacgttgtcaaattttaataattttgatccaccttccaagaatgagtatttctctcttctcaaagcttcgtatctggaaatgtattcttccttttgcaatgtaataccaatatcatcaagaccgttaactaggcagtgctttctgaaaggttctatttcaaaatgatcaacgagcacattgccatcggaatccaaaattttttgatttggtaaatcgacgcagagcttaccacccttattagcaatagggatcaatttgtcaatgattatttgttgatccaatctaataggtaataagccgttcttgaaagagttgttgtagaaaatatcaccgtaagaaggtgcaatgatggattttataccaaagtcttttagagcccatggtgcgtgttctctggaagaaccacatccgaaattgtcaccagtaacaaccaatatttcagcttccctccaaggttcaacatttaatacaaaatcggtttcttgatccttaccttgatcgtctttacggaaacgccattcataaaacaacccttttttcaaacccgttctcttaattgtctttaaaaattgctttgggataatagcgtctgtatcaacattggccttatctaatggtgcgctaataccttccaaagtcaaaaatggcttcatgccggaagagctaggtttagcaggtgtatcatctgacttcactggaatatcttttaattcatcattggcaatatcttggggagcgtcttcgggttggacaggttcagcgtgatcgtaagcagcactttcaagctctttttcatcttcggaagtgacctcaacctttggactactttggtcttgatccttatattcgaattctctaatatctacgaagtgacctgcgatacctgcagcagccgccatggctggggacattagatgtgtacgagacaaggcaccttgacgaccttcgaaatttctgttggaagtagaagcacaacgttcataggcatccaaaatatcagggttcatacctaaacatattgaacaaccagcttctctccattcaaaaccagcttcttggaaaatcttgtccaaaccttctgcttcggcttgttttttgaccaaaccagatcccggaacaaccatagctaatttgatgttactagccaatttttgacccctaactacagctgcagcacttcttaaatcttcaatacggccattggtacaagatccaataaagactttatctactttgatgctctttagcggtgtgttaggttccaaacccatataggctaaggctctttccataccagatttctttattgggtctgtaacattttttggatctggtacggaaccagtaattggtaaggcatcttgaggagaagtaccccatgtaatagttggaatcacgtcgacagcttcaatgttgatttcgtggtcaaatttggcaccttcgtctgttttcaaagttttccagtaggcaacagccttttcccattcggcaccttttggagccaaaggtctgcctttggtgtattggaaagtagtttcgtctggtttaatcatacctgctcttgcaccagcttcgatggccatgttacacatggacatacgtgcttccatagaaagagcttcaatggcttcacctgcgaattcaataacgcaaccagtaccacctgcagtacctatcagaccaataatatacaaaatcaaatctttagatgtgataccaggtgatagcttaccattaacagtaattctcatgtttttcgatttagcttggataattgtttgagtggccaagacgtgttcaacttcagaagtaccaataccaaaggccagcgaaccaaaggcaccgtgagtagaggtatgagagtcaccacaaacaacagtggtacctggtaaagtgaaaccttcttcgggaccgatggtgtggacgataccttgtctggcatcactcataccgaaatatggaacgccgaactgtttaacattattctctaaagttttgacttgtaaacgcgaatcagtttgcttgataaatgtgtctagtgatttgaaattctttcttgattcagttggaatattatgatctacagtagctagagtacaatcaactcttctgacctttctgccggcattttctaggccttcgaaagcttgtggagaggtgacttcatgaaccaagtgtctgtcgatatacaacaaaaaggaaccattttcatcttgatggacaacatgtgcatcaaaaaccttatcgtaaagagttcttggacccttggatggagtgtaaaccatgatttaaaacagcaaataataaaaatcgatagcgacaaaaactgtcaatttcaatattctttatatttgttgactgcttagatattttgagaaaattcagcggaaacagcgtgatgagtgagttaagttctgctgtttaaataagtattcaactactattgaagccgactcatgaagccggttacggacaaaaccgggcaaatttcgccggtcccggaattttcgtttccgcaataaaagaaccgctcatcatcatagcgccagggtagtatactatagaaggtcagactaaactgagtcatctagagtaatgacgccttagtagcttttacatcttcataagaaaaggaaacttgtagaatggcctggcgatttgtttgctttcttgtgatgaagaaatttcgatgcgattaaccggcaaaatcagtaaaggtatttcgcggaggcggccttcaatcatcgaatactacgtcttaatatgatgtactgtggttcatattttcaagtagtgttagtaaatttgtatacgttcatgtaagtgtgtatcttgagtgtctgtatgggcgcataaacgtaagcgagacttccaaatggagcaaacgagaagagatctttaaagtattatagaagagctgggcaggaactattatgacgtaaagccttgaccataataaagacgattctttgtccctctatacaaacatcttgcaaagataccaaatattttcaaatcctactcaataaaaaattaatgaataaattagtgtgtgtgcattatatatattaaaaattaagaattagactaaataaagtgtttctaaaaaaatattaaagttgaaatgtgcgtgttgtgaattgtgctctattagaataattatgacttgtgtgcgtttcatattttaaaataggaaataaccaagaaagaaaaagtaccatccagagaaaccaattatatcaaatcaaataaaacaaccagcttcggtgtgtgtgtgtgtgtgaagctaagagttgatgccatttaatctaaaaattttaaggtgtgtgtgtggataaaatattagaatgacaattcgagatgaaattttaagcaaactctagtaggaaataagcggcttattcttgttggctcctaattctttttagtgtatcagttcccattgataaaaaaattaaaattaaaattagaaaaattaaaccagaaaaatcaagttgattaaaatgtgacaaaaattatgattaaatgctacttcaacaggattaggtttccttttcgtgttgagtagagactctttgcatagcagccatgaagtcttcgacacttctggtagacttcttttccttcattggcttaccgttcatcaatctgtcaaaggcttcagaagtggacatttcgtagtagaaaccacccaaaacacagaagataccgatagaccagatccagacacggacgacagtaacaatatcagtccagttttcagaccaccaaccgaataaggtaaacatggtagcgatgatgtcgacagcgaagacggcaccagccaattgccaggatgggatagaagaccagaatggaccagcagctctggtaatgaaaatcaaccagttttcagtcaaggaaatttgcaagaacataataccgttcatagcaccgaagttttggataataccaccctttggtaagaacatagtagtcaaggtaatccaagaacctatagctaaaactatgcccaaaataatagacataccccataatcttggtaggttccatttaacgggctttggagagtaaggagcattatcgtaagcaatagccaaagtagcaacatcagcgaaaatagcgatgaaaacaatcaaatcaatgtccaaagagttatccaaaatagcaatccatagacccaagaagatttccaaatgtagagacaaagcaatacggtaaacaacgtaagagtacattctgtgaaaaatttgtctggaggtcttcaaagcatcaataatagcagatagaccaggagccaagaaaacaatatcagcagcagatctggcagcatcagtagcaccttcgacagcaataccagtatcagccttcttcaaagatggagcatcgttaacaccatcaccagtcatagcaaccaagtaacctctgttttgcaagatttcaacaactctgtatttatgttgtgggaaaacttcagcgaaaccatcggcattttcaacaaaatcagctaattcagaacctggcatgtcaccaccgccacctagacctaatctttcagcgttgtaaatgttggtacccaaacccaattgtctacaagtttccttagcaataccaacagcatcaccagttaacatcttaactcttagacccaagtgtctagcttcgctaacagtttgagcagtatcgtctcttggtggatccatacatggcataacacccaagatttcccagtgaccttcacctctctttctagcaacacctaaagcacggaaccctctagaagccaattcagcaaccttgttttcgtagttttcatggacatcttctgggattgggtgatcttcttcgacagtcttcaagacgaataatggagcacccttaacacaaacaattctttcaccttctggagattcgacaacggcagtaaccttcttggagacagggtcaaatggatggaattccaaaaccttgtacttggtcaaagcgtccttagcctttggatattgcttcaaagacttcaagaaagccttatcaatagcatccaaacccttcttctttctggaagcagccaaacaagcagtcaacatcaagtcgtctggagaaacaccttcaacagtgtatggttcgtgcaaggacaacttgttcttggtcaaagtaccggttttgtcggaacacaagatttcgacaccagccaaggattcaatagcagacaacttttgaacaatggcttgtttcttagccaagtaagcagcaccgacggccatagtggtggtaacgacagctggcaaaccgactgggacaccaataatagtaatacctagagtgtatctcaagattctaacaataccgttggttctgtagaaacaagcagtccagaccaacaacaaagtggcaatgaccaaaaccaataagataataccaataccgttcaaaacttcagtgaaatgaccttgaccaccagcggctttgttaaccaaagcagcagctctaccaacgaaagtgttgtcaccggtagcggtaacaaccatgaaaccttcacctctcttaacagtggaagaagagaaagtttggtcaccgtaatgtttgtcgacagccaaagattcaccagtaatagcagattgatcgatttgcaagaaacagtcttcagtgacaatacgaccatcagttgggataacagtaccatcttccaattgcaaaatatcacctgggacgacttcgttggctggaatttcaaccaattgaccgtctctgataacaacagcagtgttagccaaagtctttttcaattcatcgacaatagaaccagcttggaattcttgaacgaaaccaacaccagcgtttaacattaacaaaccacagataacaccgaaatcgacccaatcggacaaaccggcagccaaaatagcagcggcttccataacgaattgaattggaccgacgaaaaacataacgaacttaacgactaaagattctttttcgtcagccatttgattcaaaccgtacttctttcttcttttcaaaacttcatcggaagttaaaccgtaagatgggtcagtttgtaaatattcttctggaactggtctagcttcaccggcggcaactggaccatcgttatcactgtcttcgtcgtcgacaccgtgattagattgtagttcttcgattaaagcatcgatatcgtcatcgtcagaagattcagatgcagcgtcatcgtaagtcttagcaggcttttcttgagttggctgatgagctgaaacagaagatgctgaagaggatgatgaagaggatgatgtatcagtcatattgatattgtttgataattaaatctttcttatcttcttattcttttcaatgattttctttaactagctggggtatattttttttctttcttttgaatgtgtgtataaaagagagaaaaaatggttattttccaattaattaattattaacgattgttaaagaaaaaatttatcaacgaggttgatagaaaaaaaaagtttttgtagatatagaagaaaaaaagattttcactattggtgttataggaaagaaagagaaaaaatttaagagaaattagatgttagacgataatgataggacatttgaaaataatacaatatttggcctttttatataatcgaaactaatggaggggagcataagcggtacccaccatcgaccacgtttcgtcaccggtcataattggaataaacaaaacaaacaaacgaactaaagagtgtgagagtaacaatttccacagaaggtaaaaaaaaaaaaaggaaaacagaaacaaaaaaagctcatagttctactatagcttcttcagactttctgtgaacgagggaaaaagacaacaaaaaagcaatggataaacggtctcgagagatttttcatgatggaaaaggaaggaaaaaaacccgaaaggcatatggataacattctgaaaatgtctattcctgtcaaaagcatgtcagaggtctcgaggcctggaagtgccgcattaggaaatacagatgcaatgcgcgcgagtttacgaaattctcgcaggagtttctccggccatgtgcggctggttctacgtctcgtgtatgggtttatttctgcggtaattatcgccggatctccgcttcgagaccgggtttgttttcaaattaccggaaaaggtcaggcaaaacagagtgatgtatgggtgatcccagcaatgcctgtttatgtttctccgtttcaggaagcttgttttgttttttccccgtcagcgatggtgacgtaaacgactttttgcactttagcaaagctgagttaatctcggaaaatctctgtgtccttcctttttcttctagcttccgttccgagtctcatcttctttcccgtgccgtcgggtttagtaaagaaatgtaaagaaaaaatgtcgtatcgtacccgagaaatatttcaattctcttacgtatgcgatagcagttggaaagatctgattcgttacgatgacttgataagcgcgggctttttcgccctatacggcttgggcctgactaaaatgtgattctgtgttttacgtatatgcgcgtatatagagcaattgattgacttattacgcagtttatcaagataaattctttgttcttgcttacgggagtgtggtaagcatgtatacgcccgtttaaaaacccgatggaggctttttccccaattctcgtactccattgggcatatgatttctttctttttccctttttttttttctatttccctaaactaacagaacaagcttcaaaacaaatgacggagagaaaaacagttttgatttaccaaatgcggcaaacttattgaggctagacacagctctaccggattcgtccgagcacttttttgttttcttttctatatttactacaaacataacaaagttttgtgcgtcttccctaaagcagctaggatgaaaatcctatgctctcatctcgctggttgccatctcatcgcatccaatgctgtctgtaatcattttattggacttttctttgtttgctaatcccccttttctttttcccgttcttttcttgtccttgtttttcattttaactatatttctgaaattaaggaaaaataaggcaaaaagtgggtggatgcatctgcgacttctctagttttgcgcctacttgggcgcgctaataataagggtttagcttcttaaaataaaaatgtcagtaacagttgtacgataaggtctttactttttttctctcgagaaatgtctttttctaattaatctctcttttctgttgttggttactgccttccatagtccaagaccattcgttatatggtgcagtgtaggatcgaggagaatcggctcacggtgcttatattattgcccggcttcaagtatatttacatcagtctccatagttgttttatcttattcttggcattgatctgcttattaaactatttatcggttctctcttctggtacagaacttaacatgatcttgttttcactattgtgccataagctgaaaaggctaaaataaaattaagatagtaaagttcactcttaaactaatcaagcatgaataatacaaaataaatatttgagccaaaggggatgatttaattatcaagtttttcttttcatacttcggtttacaagcattgtttacggctcttcttttcttagttcttggcagtttgtgttttcttgatgagaataagaaaagtatcgatcttacggcaaaacataaataaaacacaactttatctttttttgtcgcagtagtgtggtcctacagctccaagcctgccgcttttaaaatagtgagctgtgcatactgatatatgttctattttacccatttgaggggcctaaattgtctattaatttttttactttgatacagtttgtatagaaacatgtggcactaacagctctatccgcccgcagaaaagatgaaaaaagggtttttacccggcaaagaagcttctccatcatttgtcagggggaaaagaaaattaggaggctcaggccctagaagcgccctccacgctttttaaacgaacgctaatcttcataattcattatcatcgccacttggcattgcatttaatgggcgccttccaaaaacattcaaatagtatcagcccccccccaaggaaaggctttatttgaattgcgttaaatattcgatttctttctagcaattattaccaaaataaattgcaggcttaacgaaaaattaaataatctcttcagattttttcacttccccaaactacattttagtcaggttggcacgattcaattgagaaggcttaggttaagaataaacattttttcataaatttgaggaagaaggggcttttctggtaattttcattcaatagaaaggcttaagaaaacgtcaaaaaactcatgcgcctccagtaaaaactaagtgtattaagagaattgtatcacatatatacgacattgaattaaagaaataaaacttgaacaaataaagtttagaaaagtggttctaaaaaaaaaaaaactgtgtgcgtaacaaaaaaaataatgtctagacaagacgaaaattctgctttactagcgaataatgaaaataacaaaccatcgtatacgggaaatgagaacggagtctacgataatttcaaattatcaaaaagtcaactttcggatcttcataaccctaaatcaataagatcatttgtcagattatttggatatgagtctaacagcctcttcaaatacttgaaaacagataaaaatgcaggcatttctcttccagaaatatcaaattatcgaaagacaaaccggtataaaaattatggcgataattcacttcctgaaagaataccaaagtcttttttacaattagtatgggctgcttttaatgacaaaacaatgcaattactgacagtcgccgctgttgtttcctttgttttaggtctatacgaactatggatgcaacctccacagtatgatcctgaaggaaataaaattaagcaagttgactggattgaaggggttgctatcatgattgcggtctttgtggtagttctagtgagtgccgctaacgattaccagaaggagttgcaatttgcaaagctaaataaaaagaaggaaaaccgtaaaattatagtcataagaaatgatcaggaaatattaatttccattcaccacgttttagtcggtgatgtcatttcattacaaaccggtgatgttgtccccgctgattgtgttatgatatcagggaagtgtgaggcagatgaatcatccatcactggtgaatctaacacaatacagaaatttccggtggataactcattaagagatttcaaaaaatttaattctatcgatagtcataaccatagcaaaccattagatataggtgacgttaacgaagacggtaacaagattgctgattgtatgttgatttcaggttccagaattctctctggcttgggcaggggtgtcatcacgtccgtgggtataaactcagtttacggtcaaaccatgacttcattaaatgccgaacctgaaagtactccattacagttacatttgagccaattggctgataatatatccgtttacggttgcgtgtctgctataattcttttcttggtccttttcactaggtacttattttacataatacctgaggatggcaggttccatgatctagatcccgctcaaaagggttctaaatttatgaacatttttatcacatctatcacggttattgtggtggctgttccggaaggtttaccattagctgtaactttggccttagcgtttgcaacaacaagaatgacaaaagacggtaatttagtacgggttttaagaagctgtgaaacgatgggatctgctactgcagtgtgctctgataagactggcactttgacagaaaatgtcatgactgtcgttcgtggcttcccgggcaattctaaatttgatgatagtaaatcgttgcccgttagcgaacaaaggaagctgaattctaagaaagtttttgaagaaaattgttcgtcatccttgagaaatgatttattagccaatattgtcctgaattctaccgccttcgaaaacagagattataagaaaaacgataaaaatacaaatggtagtaaaaatatgtcaaaaaatttgagttttttagataagtgtaaatctagattatcgttttttaaaaaaggcaacagggaagatgacgaggatcaattattcaaaaatgtcaacaagggtaggcaagaaccctttattggctctaaaacggaaacagccttactcagtttggcaagattatcattaggattacaaccgggagaattgcaatatttgagagatcaaccgatggaaaagtttaatatcgaaaaagttgttcaaacaattccgtttgaaagttctcgtaaatgggccggcttagtggtaaagtacaaagaaggcaaaaataaaaaaccattttacaggtttttcattaaaggtgcagcagaaattgtttccaagaattgttcgtacaagaggaattcagatgatactttggaagaaatcaatgaggacaataaaaaagaaactgatgatgaaatcaaaaatcttgcgtccgatgctctcagagccataagtgttgcccacaaagatttctgcgaatgtgatagctggccccctgaacagctgcgtgataaagactcaccaaatatagctgctcttgacttgctatttaacagtcaaaagggcttaattctagatggtttacttgggattcaagaccctttacgtgcaggcgttagggagtcagtacaacagtgccaacgtgctggtgtaactgtgcgtatggttactggtgacaatatattaacagcaaaagcaatcgcgaggaattgtgcgattctttctactgatattagttcagaggcttattctgcaatggaaggcactgaattcagaaagttaacgaaaaacgaacgtataagaatcctgccaaatttaagggtcttagcaaggtcttcgcctgaggataaaaggttattagtagaaacattgaaggggatgggagatgttgttgcggtcactggcgatggtacgaacgatgctccagctttaaagctagctgatgttggtttctcaatgggtatttccggtacggaggttgccagagaggcttctgacattattttgatgactgatgatttctcagctattgtcaacgctattaagtggggaagatgtgtttcagtctccataaaaaagttcatacagtttcaattaattgttaatatcaccgcagtgattttaacgttcgtttcatccgttgcatctagtgatgaaacatcagtactgacggcggtccaactgttatggatcaatctaatcatggatactctagcagctttagctttagccactgataaacccgatccaaatatcatggacagaaaacctaggggccgctcaacttctttgatttctgtgtcaacttggaaaatgattctatcacaagctacattgcagttgatagttactttcattttgcatttttacgggccagagttattcttcaagaaacatgaagatgaaataacaagtcaccaacagcagcaactgaatgccatgacattcaacacttttgtttggttgcaattttttaccatgttagtatcgagaaaattagatgaaggtgatggtatatcaaactggagaggcaggatttctgccgccaatttgaatttcttccaagacttgggtagaaactattattttctcacgatcatggcgatcattggcagctgtcaagttttaatcatgttttttggtggcgcaccattttctattgccagacaaaccaaatcaatgtggataaccgcggtactgtgtggtatgttgtctctaatcatgggggtgctagtgagaatctgccccgatgaagtagcagtgaaggtatttccggctgctttcgttcaaagattcaagtacgtatttggactcgagttcctcagaaaaaaccatactggaaaacacgacgatgaagaagcgctgttggaggaatctgatagtccagagtccaccgccttttattaatagacgcgctctatatgtttatacaaatgtaagtgaccaaatgaaaagatgtgtgtaatagttatattttcaaaattgtacactatattatataatcaataaaaagaaactatctgaaatagcatgtcctcctaaacaaattcctttttacccttttatgcattacaagtggaccaaaaggactggaaatggtaaaaagaaataagaatttaaacatgctataaatttcttttgttaattgcaaattttttgtttttatcaccgattatgatatcataccatcgtcaatattcttggttgataaataactttgtgcttttgattttatgctctccgaaaagttgctatactcagcaaagaacttatctaggcctttaaacagacatttcagttcagaaagtgaatcaattctcccaatcaaatccttgtttgtttcatctttagcctcgttatcaatcgcagagcttaaagattcatcgattgtatcctctaatgctttcaatgatgttctaaaatctgttatcgaaagatctgtccccgtgctggttgtattattttctctaactgtcgaaatattcgtaacggtcctaacttgttccaggtaatataccactttttcaattctctccttaatcaacattaaactttgcagttgttgcctcacattggtattgcgattattttcgttatctagatcgcttagtttctcagttacattatgcattcctgtttctaatgctcttacagcacttgccaacgtatctaagtaatattcaagcttcgatgattttaaggattcagtagaatacaatgaggaatcgttctgttctgcttctttgtgatacctagaagatgcccaagttcttggtaacgtttgagataatttatccaaattccatatggtgctttccaactcttttgtaaggttctttgtgtaaaaatccaacctggttaatagcaatgaggatactgattgcgtttgaatctgatcttcgtttaaggcatttgataagagtatatcaacgaatgcatggggaacgaactcctcatcaaaaaacatactcaatatatcatcatcatcacccgtaattgtcaactctaccatattctgcttagtttggccttcttgttcttagtgaattgttctattttagacatatttcatatggaaataaaatgcattatcaccctcaaagcgcattacgccaagctcatgcagcgaagtgaacttttttgaaaaagttactagtacgaaagaggttaaggattacttaagttatacaaagcgcagaagttgttttttccaacttcaagcacctccccatttgattcatcatcagaaacgtaacagaattggctgacctcatcgtcattggaaactaaaaaggtgggcgtctcaaattcaatagcgggccgttcactttctgggtctgaaataatgtcaagcttaatactggtgtcgaatccagaagatacaaataaggctccggctgcaaagtagacattgtttattggggtgccttcattaattaaaaactcaccaactgggcattccggtgatcttagatcccattgagctagcattccattttcatatccggcataaatatagtttgcattattgccatcgactgtcaatgaattacatgaacatgtgaacttgcttgggagttgaatagtttgctctttggaaaatacattatgtacagtaataacaccagaaacgtgaccagcaatcacatattttccatatgttccaaactctagattatttttcttggaagtagaaatttcatgtaattgtctgtctgtccctacgaacagcgctatgctgttaacaccatcatgcgggttttcttttctgttaaacgtgtgaattgtcgttcctgtgccgcactcccaaaggcgaattgtaccatccaaagaggcagagagcacattccttcctcggtctattatggcaatatctgtgactgtcgccctgtgtccaattaacgtgcgaggatttgagccgtcttttactgaccagatctttaattgcatatcctgtgaactagatatcaaagcttcaccgcttggaaaaaactttagttttgttatttcactaacgtgagcttggtcaatttctctttgaaggttgaaatttgaatccaatactttaatatcgccttctgtagtgcctaatatgaaccgtctcatctgaagtttagctgtgtctacggcagtataatccgccctcttgagcatctttgaaccatctcttatgatagtattgaataaaaaatcatgtccatccaaccgcgccttgtataagtgggagccaaccttttcaaatgtatttcctttgcctgcatctacacccctgctatttcctaacactactatcttatgctccttgatttcatttaggtttttgtcaacattgatgtaaaattcatcgtcattttcatcattttcttccagaacagctttaaaatcatactggatatgagcaactgtgatggtcttagtcattgtcgtttctattgtacttcgctatttctttttactttctgctcttagggttgaaaacttaatttttcgaagcttcttttgccgatttctagattattcgcccatcctgacgcctgtaatatgtcatgttaaaaacatcacaaaagttaataaggttaactgagccttattcccaaatcctgacaaggacaaatgccatttttaatgtgcaagaaaaaggttccatccagttttctaataactggatgacgaaattttaacggaacttattaaccgtctctttttatattgttacgtattttgtatgcttggtaggtacgttaccttagtacataagtgttatcgttaaaatcttctcactgaaacaattgaactaatcaaccgaccttgttagatgagtgaggtgtaagtagaactatatgaactactgggcattcgcaacaacaccatcagatatactagtacacttttttttacagaatttttgagatgatattactactatgaaaaccctttactaacgtatttgattaaatgcgtcaaatattaacgaatttggctgtaccttcgcttttggtttatcaaaaagtttccaatatcgcaatgtttcatctccagccccagaaaccaccgtggttccatcattggataacgttaaatgcagaaccctgaaactatgacctttcagaattgcaattggatccatagagttacagtcccacaaggttaagttatattttgagtaaccatgtgatgtcacaagctcgttagtattctttgaccataccatattacatatttgagagccgctatctatatcactcatctttattgacgtattaacgttccagatttttagtcttctatctgctgtaccaccaccggtagctagcacacctcgtttatgaggagaccaggccattgccttaacagcagccttatgttcgtcaaacgtcaagattggagatttcgacgttccttcgtaaacatggacgacgttatcgttaccacctgaggcaagtttgttgtccgctacattccactttaggccacagacttcctgagtgtgcgattctatagtttcaaaaaagggatctggcatcctaacatccctatgcagtattcgatgatctctactcccagacgtcaaaacatgattattccaagataaacacgctactctgtcaatatgtcccgacaacgtcctaatacattttcttttcattacgtcataaatttctacaagtccatttgcttgacctactgccagatgagagcctgctccaatccagcttaagcttgtgtattcgttttccgtgtcgcataagtgaacaacgtcgccagtgttattatcggttaaaaaaatcgattttccaagagcaactgccaaaacatcagtacttgaccaatctatcaagctgtagtaaaaatcgtctgctaatgatggggcatctaaaactctatagggaactttagctatttgtctaaattgcttccccggtgataataggagctgtttggaatccggcctaactggcgacatggaatcaaaaaattgagattgtaacaaagaggccgcagatagtcttctacctttacgttgttgataagtcaacaggctggcgcccctaactgagttgcttgagggtctcgtgatttcatcttgctgtgatgtaaaaagacgtcgaggagtgactggcgtggaatgtggcgaaaattcctctaaaccagcagcttcaggaggtggagttgatactcgttccagttcataaccatgtctagttgtattttctgcgtgcacattgcctctagtagatggtctcgtattcttaatgcgatctatactgctctctgagcctaccgtatccttgcttagcatctcgccaaaaagctcattcttcagcaaagtattataagtttcatgtgcctgtctttccttttggtattctacttgatcttccgtactcgatggattaagggctggaacgcttgccatactactgatggaaacgatggaattgaaatctatatctgttcgggaaggaatatacctatcaccatatactgtagacggcctcgatcgcctggagggagatgataatagtgaggcggacgaagaactagatattggccttttcgataccctcttactttcagaacccttgagtggggaggaggaaggcgtattattcatgaatgggttcaggtttgtggacatgcaactaaatttaggatgaagactagaaggaagggtgacaaaaatcggagttagaggatgaaccaagtttgagatggccaagtctaaggtattgtaaatccatgaggttcttcttcatcgcaatattaatgctagaagcggtgcaaaaaaccattttgtgtgggataaaaaaacgtcgtggaattagaaactcgttcttcgggtaagaaaccaatatcgacacaacaagatatggggtgtatagttaaaatctctactgatagactttattggtgaggttgtgaacagattgttggcgctttcttccttatcgcctcaatctgaaaggatctagatttgccaatgttatcacactacatcttcctggcattcgttttattgccattcagagtttccgcgttttacttctatggttatggtggagacagaaaatgcttcctgaaggaactatccaaagacacccttttaaaaggttcttacaatttggaagtttacgatgataagttggcagattatgcgcttcccagttataatgactatggcattgtcatagatgtggaagaagtctttgataataatcatagggtagtccaccaacagggctctccttccggtgacttcagctttctagctttggaatctggagaatataagatctgtttacagtctagggtaaataactgggtagggaaaaccaaaacaaagttagaaatcgaatttgaagtcggttttgaagcaatgttggacatgcaaagaaaagaaaccttggaaagtttgcacggaaaagtcagtatattgaattctaagatcgtggatatcaggagagagcaacaactgatgagagaacgtgaagaatcctttagagacatatcagagtctgtgaattctcgcgcaatgtggtggacggtaactcaagttactcttctcattataatttgtgtatggcaaatgaaaagtttacgctcgttttttgttaagcagaaagtattatgaccgtacatatcaaaaaattgaatccttagcaggcatacatgagaatttcgttgtttcaatgatttatttctatttatttacatgcattaccccgacgcttcatagtgtagtcattaaatgagtgtatacatatatatactaacctagtcatcaagatgttttaggtgtttcaattcttattattcatctataaagacagaataaatatatacggtgcgtatcagatatgctatttcaacatactatctttcgataatcggatcaaaaagctcctaacgattgccattacaaaccttcgtccatccaggccaacgttttgttaattccttcttcaataccaactcttggtgtgtagcctagcaactttttggccttagcaatgttgtgataacggtatgcacacacaatcttgactctgaatggagtcaaacctggctctttacccagcatcttggatacccattctgaaagataacctgcacaaattgcaactggccttttcaaaacaataacatgtttatcaatatgaccatctgccttccacacagtacgggccaaggcccaaaaataggtgggggtatcattggtaatgaaaaaagtttcacccgagacagcagttcttgtttttggatcgagaagtttctgtgcagctaacacatgcgcgtcagcaacatttccagcataagtccaatcaaatagattgttattatcaccaatttggaacttcgactgccccaatttcgcaacctgtcttagaccaggtactaattgcctatcacctgggccaaaaataccagctggacgaagagcaacagtatagaaatcactgcttggatcattcgccttcaagaccatatcttcggcgatagctttagtctcattgtacgcatccataggaacttctgggattggccaggtttcgtctgcattgtgcacatcttgcccattaaaaataacaccagcagaggaagtatatacaagtatattaacgccacatttcttgcacatatctatcacgttacgggttcccttaacattcactatgtcataaatatctggattttgaccatgcattggagaagcacaatgaacaacaacatttgctttactttcgttaattgcgttttccatatcatcaggtgatgttaaatcacccttatgaaattttatgtcgtctacattaaaagtaaactgttttgaaagtttttcagggagatctctaacatcaaaaatgtggatgtctggcttaggattaatatcaaaaaattgctgaattaagtgcaatccaagaaaaccagaaccaccgataattaaaactgaatctatctttgacatatttatttttgtttgcccttccaggtagagttgcaaataaaattggacaaaattgacaatctatattgttgtctattctattttatagctgcagcataatcttttccttgcaggcttatatgagatttttaaacgataccatttctcgagagaacaataaacgatctatagggactatcggaccgagaaatataaaatccacaaacaccgacaataaaatagcctactaaaaaaaaaaaaaggtcctggagaaagcaatattcataccgcattaactttcattgaaccgaagatctacaaatatcctttccttgcattataattatccaatactttgtcgtcaatattctttcaaagaaagaaaaaatatgaaatcaaaattaaacatttttctgtaatttccgtaatacaaaaaactattttcttttcggaaggcaaaaacaaaaattataataaaaataaaaatatgtataatataatttttatcttctaactttttatttattgaatttttatatagtaaatataacacgtgatatatttgaaatgtgattatattatatatattgatgtttacatattttttatgtagtacaattaattttcaaatttatcgaagctcttaaaaagctcaagaagcaaatttccatgaactacattcaaaatttgcgtagcacctaaattcgttactcaaaccattagaatgttcaggaagaaaagttgttattcttgtgtcagaataaactttggatatgacttcagacattctttcaccagtacaacttatgaggcggtgcttaaaaactcctttcttagttttagagttgtcatttggcgctaataaacactttgcagtgatagaggctattttatatcaatgaataacagttagtaagatgaaaagatactggaaaaaagattaaaaaatgagtagggatatgtttatgatatacatacactttgtttgacaatcttcatttaaaaaaggtgggtcaattaacaatctatcaacttttcctttaatttcatcactgaagtccagtggtttattgtaatcataaaaaaagaaatgatctcttccagctaacaactcgaatctcttatcaaattcgaacaagtagatatgttcggttggaatttcattagtaggtttcttttgaatggcagcatagacggatggcgcactaactattgcaattacagtgttttcgtccgcaccttccaatatggcatctgctaaaattgcggctgtgtcatcgctgtaccaaaactgggaaagctgccaatcttccttgaaaagcttcatcccttcttctttttttttcttttggaagtcttcatccgtttcgtcgtaaagcttttgaaaggcttcttgatgttgttgttcctctcttttgaattcttcaagggcagcgagggcattagcagaaagtgtcctattaagtttcgtgttagttagtaattctacgttactgtgttgaaaatatcctgtacttacaattcataatcggagtcggagtcggagtcggacattttatcagtgattctttcggtttcattaagatgtaaagtgactgattagtatattagtcaagattaatatttttttttttagttcctccagttcaaaaaaattttgttagatttaaccggcataaggttcagcgatacagacgaaaaaagaagcctctaaatgaatgggaaattatatatacatgtatattatgcagttgatattctatgagatgacaatactaaactatatacctatatacattgcccatcttggattttgctgccttacagatgacaatataagttatttagagattgagggttactagtgcataatatttgcgtgatttccgaaagtacctctgaaggtcccatgttgtacaccaaatattataaaacagtctattttacgcaaaaattttaatcacatacgtgctagcaaaaagcattttctgatgttcacttggtgattgacataccagcttcgtatttgtcaacgtgtttttttaaatcgataagcgtattgatttttttcaaaagctcctcttgtctttccattacatcaaatgagggcatcacagggcgagaaggtaacgataattcttgaagaatggcgagaattttgttctgcagcgcaggtttgaaggtcgataattttgtagatcttaagtatacacccggcgatagcttctcaccatgcgtaatcacacctaaagccttcctttcatctgaattgaaatctttcagcaattgttctgcatatgcgctttctgactttcttttgagcgccgtttgcatttcctgtctttgtcttttggttttcttgggggagagattttccttgacttctgacttttttacattcagttgttgaagttgcctatgttgggcaaactgctgttgctgcttcatccaaggattttcagggatgttcaaatcgtgcttccgctttctagttttatctgctagaagcgcgttatataactgagacattccctgagaggtaaggtattgtgtaattgtctgatctgaatgtggcgagtccaacagtcggagtaatgattctctttctgcaagtgttctcttggcagccatttcaaattttttggactctactacgagtgcctcttcttcagcaatttctgctgcagaacgagaaagaagacgctgtaaatacttttttctctctatctccttttcagctgaaaaattcaaagaagataaaagcggattgctaggatcacttgctttaaaataattcctacaggtgtaataaaatttttctttgagatcttcaagtgttcttgaattattataactgtatctgtcaaagatcaggaaccaacgtaaatcgtattttttgcagagattgaacaggtattctatttcttcaaaagaccagctatttttactttcatccttcttttcattagtaaagttttcgttatggtttttttcactttctacgcttttttgagttccttcgttttcattcataaaagcctcgtactcctccttggtgaatgatggaatagataaatgctgattgaacttagaatatggcgattcttttggtgtgtctcctattaattctttggaacccttgacccaatgacgcagagtcacagagttattagctttgaactctacaaatgaccaaggagatggcttggacgtcgaaagcattttttctttaaagttatttccagacttaataacaacggggggttggttctctcctagcaggttaaatagttctctttgcatgcccgtcacttgaggcttgggccggttggctgccgaggacgaaggcactgatacctggccattagttggacttctggatttttgcttaatgtttagtacatcaaagatgtctgatgatgacatattacctgtggtttttttactaaattttcgtattatcggagaaatatgttatgaatgcttgttgctattaaaatacaaagtggattcttgatttatcactaaatagctacccggagttggcgcatcgcaacttcattaaataagttcgagtgtgcgtattctaatctgattcatataaagtatactctaaacgggctaactcaaatctgaaattagggctactatatgataactaataagaaaataaagataagtgtcccagaaaaactcggtttgtcagaagaatcttttgaggaatcctgggaaacagttaaatatgccattgatcatatatacagcgatgacatggccgacctttccttcgaacaagtgtacaagaccatttatactatcgttttaaataaaaaggggccaatactttataacagattgaaagattatttaatccaaaaattagcgcttttgagggaaacgatagtcaaggacaatactcatgattatgagtttcttggaactatggcacggttatgggaggtgcaatgccattgttttaaaataacgggagacttaatgatgtatatggacaaagtttattgcaaaccaaatagatgcatggaggtatacgacatgtgcctcgatcttttccgaatcgaaatattgcaaaaatgctcatcttctctcatctcagcactgatatctgatatagaaaggattcgtaatttaggatctgtcgactccgaacatactagtttgtggaaagtactaataggaatgatggagacattacatgacaatagagatagttttttcttaaccgattttgagccggttttgattagcgcgacagaagaatactacaataaagctattgatattgaattattaacgccaattgagagcctggaaaagattaggaagttaaggcagtttgaaagtatgctagactcctcttttctaaatgtggattctcataataagttgaagactgtattagaaaatgtccttatatggggaaagttgagtgatattattgaagatctaacgcacgaagcaatggtaatttcaaatggaaagctactccaagaaatttatgacttgtcaagcgaggaaaaatatcgcgttactgtcattgaatctattaaatcttacatcaataaaaatgccataaatattccttttaatgaaggtaaccgcaaaaaagggcagaatgcgattacttggtcttcggaaattgtagagctatatcgcagtcaacactcgtttttggaaagtattgattttggttctgttcgtcttaataatttgaccggggatgtatctaatgcaatacttggcgatgttttctcaatgtatttctctaaagaaggagcattaccatctgagtatctttctacctacgtggaccattgtatgaaacgaaccaaggaaaaagatgctgaaatagtgaagatcaagcaagatttgcttgatagtaccaaattaatcggactcctaactgagaaggatatatttgaaaagatttacaaaaaacaactctccagaagattactgcagcagaggtctttagtggaaattgaaaaatggatggtgcaaatgataaagaaggttctaggaactttttttacctcaaaattggagataatgctgcgagatatatctttatcctctgaaatgtatcaagcattccaacactcaacaatcaacagcatagaatatttgagttttgcaccacaagttttgacgagaacgagctggccctttcagagtactaatccaattgatgaaggtatttcactacctcctagaatgtcacaaattttagctggctttgagggctattacagcttaaaatacaaagaaagagtgctaaagtgggctcatcatctaagtgtaattgaaattggctgccaatttaatagcggttactacgaaataagtttttctgtttacgctggagtgattttccttctatttgaagattatgaagaattaacgttgggggaaatatatgaactaactcatattcccatagatgacgttaagtctcttgtaatgtcaatgtcgacaatacccagatgtaagattttgaaaaaatcatccagttcaggaaatatgaaattttcagttaattatttcttttcttctccaaacaggaaagtgaaagtgccggttattgcatgccctctaccatctcagaaatcagataatttggcaaccgcaagttccgtggacacttatgataatgaaattgttatggagcttagtgctattattgttcgtatcatgaaaacagaaggtaagctaagccatcagcaattacttgaaagaactacgaaacggacacagtctcggctcagtcttacaccgagcattttgaaacgaagcattcagcttttaatagagaaagaatacatccagagaaacgcagatgacccctcttattaccattacctttcctaattgcttataatgaaaatcacaggtataaggtttgcagaatgccaacagtatatatagatggcagttcctatccggctgccagagcgaacaatattaagaggatatgcgtcgatactaattgaatgttcatcctgcattccttagtgaaactttcaaaatatataataacatagttatggtagactatatatcccagtcaaacttgaatgtaatgtggagtgggtaatcgatatctcttgaagtttattatgcctcattatatttttataaaaaacttctaggaatttgttgagtcaaataatttctttcttaatcattaagtaagttaaagttacgagcctttcagacctgcgtagcactgcttcaaaggaactattatcaatagcagcgccttgctcttttttttttttcagatgcttagcggccgtatttcacttttcctggtagaaaaatatatgttgaaatttacggtataagagaagctcaccaaaattattatcaataaagcggcacttttaaatttggtattcttccctggttgtcaagccttggtttccctttatttgatagtatgagcgaaataaataatgaaaatctagagccaacctcaagtacagtagctgagtctacagaaagcaagaataaacacattcgtagcgctttaagaaaacgaagaggtaaattaagcgcccaaacttatgaggaagatcaagaggctattttatcatctcctttattgacttcaacacctaaaacagtctccaggtcattagtgaggttatacccatatttaattgttgtggataactttctaagtatcatcacttggtccaatgacaatgtctctgcaaacttgcttggaatattcttatttacggtttgtgttctatattttggatttattacaaggtattttggacatttaatgatcgttggtataatatgggtatatcttttaattgacaagcacgttcaagaaacaatggcatcttgcccttcattggatgatataatacacgttatggatagggtttctatgaaatctagcgctgtgttatctcctattacgattttgagcgctcaggatgttagaagactgttatttaccattgccttcctatccccagtttatatttttctaacagtgtttgtgctatctccaaactatttaatgttaatagggggtctgtatgtgcttacgtaccattctaaactaatccgaagaatgagaagatacttgtggaaatttcgcgttgttagattacttgtatttttcataacaggattagaccttggtggaccagataataataggcgcttgtttgcttctgtcaataagaaaataaggtcctttgtttggaatgaggtagggaacacatctaacactaaaaagactgtacttttcaaggttgctctgtttgaaaaccagcgccgctggcttggcatcggatggacatcaactatgttgagttatgagcgcgcatcttggacagatgaattcctaaatacttctccaagcccagaagtgtttactttaccagaggagcagtcgggaatggcttgggaatggcacgataaagattggatgcttgacctaacaaatgatgggatcattcaacttcctgcttctgctgctaagacaaaagttaagccaggtgcagatgaaggtttcatatattatgataacacctggaataatccctctgcaacggacacatataaaaagtacacaagaagaaggaggtggatcaggactgcaacagtaacaacaacgtatgacgatgagcccactgtagaaaaagctacaccgaattctcatgctctgaagagtgaagaaaataatagagttagaaaaagaaaagtgtcatttagtacagcaaatgaagtgcatatcataccttcctcggacagtagcaaattaatacaaatatctgatgtttcaatgtctccttctctataatgagtgcatgccccatatggacaacaacgttcacactggtcggtgcaagggcacacagcaatctcagagtttctttcattggctgcatggagcacaaattcaatcttgtgctttaaagtatctgcgcggttatggcaagttctccatcagtctcttattccagcaagcattcttttacggaacttcaatgcatctaaatacatatgtacagatagccaaaactaatagagacataataaattaaacaaaactgtaaattttaaaaagagtatatatagggctcaagaaactgcgtaaatataaaattaatgaagaaaatctgattgtcaactaaacgacatcttccatttctatttcatcttccaagtcagcctccgcgtctccttgcgcattgtctccagcggaacctgtttgctcatcagctagttcacctaaggttgcctttctctcctcctctttcaactttttatactctggccttaaagtgtatttgaatgcatatgggcccttcttcactagagtggcaactttatccaaacactcctttaaatgtgcttcaggttgcctagtacgttccttcaaccccttcaaggaccagtagtcatactcatcaaataacttgaacaagtaatccaagatttccttctttggcatacgaatagatttaatattgctcttggccttctcacgccccactttcaagaaattcgagttgtctgacctcatggacatacctgtgtggctcatcgtaacaccaacggtttcatccaaagttgtgatcctttccttattattaagcttgacaatatttcttctctgttcaacaatcttgtgataattaggatcattcattgatggcataacctgacattcgtggcaaactgtacccacaatggcggtttttttgggaatcgtcttcacatatggtatatatctatctctaccatccctatctgtcataactctgtgattaaacttttttctattatttctacgtttttgctgctgctgcttcttcttaagttcctcttcacgttcttgcttcttcaggtaagcttgcctttgcttttcaggatctgcttccaactcctttttacgttgttgatatttctttaaattttgttctgtgaaaacatattcattttctactactttctttgtaagttctaaatcatattcgtgcggtatagaatcgttatcattttcattcaatagaagtgtgattttactcccatccttgtttatcctaattttacccagttcttggccatgcaagttgtttctgtccctccatttctctgctagaaacatgggcaatctaactaaccagacttgtctattactacgttccaagtccaaatctaaggattcttcataaactttggtttcattattctcaatatcattaccgtcaaaaacttcctcctcttgcgaaagatactcatcaccggaaatgttacctgatttctccttcgcgacagagttcgtggaattattagaaagtgctggtgcccctgctgaaccactgctcatggtgttaagttggtcttctattttactcttaatattgcgttatgcgttgaagccaacagcatatgtcttattcttctaatttcaagcctgataatttattcatttcgcgcaagggaagatgaaaaagttaagaagagaatcgacctttggaaagggccccaatggaaagaacttcaatgttttttcctctacaagtaataagagcataaaatggacctagatctagccagtatcttaaaaggtgaaatttctaagaagaagaaagagctggccaactctaaaggtgttcagccaccatgcactgagaaattccagccacatgaatccgcaaacatagacgaaacaccgcgacaggtagaacaagaaagtacagatgaagaaaacctgtcagacaatcagagtgacgatattaggaccaccattagcaaattagaaaatcggccagaaaggatacaagaagcgatagctcaagacaaaaccatctctgtaatcattgatccatcacaaattggttctactgaaggaaaacctcttttgtcaatgaaatgtaatttatatattcacgaaatattatctcgttggaaggcgtctttggaagcttatcatccggagctgttcttagacactaaaaaagcactctttccactcctactgcaactacgaaggaaccagcttgccccggatttacttatttcccttgcgaccgttctctatcatttacaacaacctaaagaaataaatttagccgttcagtcctatatgaaactcagtatcggcaatgtggcctggcctattggtgttactagcgtaggcattcatgctcgtagtgcacattcgaaaattcaaggaggccggaatgctgctaacataatgattgatgaaagaacgcgattatggattaccagtattaaaagattaataacttttgaagaatggtataccagcaaccacgatagcttagcctaattgttgaactattgttttcgttatcgcgtggcacgatatcatgcggccaaaataagaagcaagaatgcagatgttgatagcctttgttcaattttccagagacaaatgctttacaggatcgggacttgaaatatactgactggatgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatggataaatatcagtgccaatatgttgttcatggtgatgatatcaccatagatgctaatggagaagactgctataagttggtgaaagagatggggcgcttcaaggtagttaaaagaacatatggcgtaagtactaccgagattatacatagaatattgacgaaaaaatctttgccaccgactcatcctgattattatcccaccacccaggaattgagtttctattctgtcgcccaagatgccgtttcaaaacattgttatgtctttcagagggatttggacaatgtcttggtcaatggtggatacaaattcgatgcagaagattgtgtttatgttgacggggattttgacttattccatatgggggatattgatcagttaagaaagctgaaaatggatcttcaccccgataagaaattgattgttggtattaccacaagcgattactcgagtaccattatgacgatgaaggaacgcgtcttgagcgttttaagttgtaaatatgttgatgccgttattatcgatgctgacgccacctcaatgtctcagtataactgcgagaagtatcatattggcacggctgtcctcactgctgccggaaaattcagtgaatacttgactaaagagcttattgtgaagagggtggaatcgcaaagggaggtttacattgcgaggaaccaaaaaaagggaatgtccatataaacaaatgttgaaaacttcttcgaacgtaaattaaatggatgtaagaaaactgtattacataagtcatgaagtaggcatgcaagtatatacctatagatgcatataaatcagtggagaaggccactatccttcagagatcaaaaaacctttttttatcttgaaaacgccctcattccttttggacgttttcaaacttttgttcatgcgattgcaaatttgagcctcttctatctttcttgaacactgggggtatttcaccattatcaattaagtcatcaatctcatcgcctggcttaccccaattacccttgccggaaccttgcttcttgatgtgatttggagattcaccgtagttaccagtgtgcgaaaagtactttggatcagcctttccttcacgttcggtccacttgtttgttctcgtcattttttctgattggttgtacacttgagcggtttgttactgttgattgttcgtttatttgtataattgagtttacacaacaattgttacaatagtatgggtaattagggccaagagagtgacaaaaagcaaacttataaatagtccttttatacaaatgacaagtgttcgcttctgcgctcgcagccccctgttttcgaaggagtttcttagcctaagctaggcaggcgcgcccccattatctatcccttcattgcttactgagaggttttcctccccccctccgcgtatatttcctccgctggagaaaattagttgtgggacggatagcatcacttaattctgtacctttttgaaactggcttggtactttctgttggatagcaacatttcccgctgggatacttcaacatgggctatgaattttcttttgtcttttatcttttatcttttatcttttatctttaaattatttgagctcggttaagttcataactattgcgtgcccgaatggtattctttcaattcacaaccaaacattaaaatgaagaaagcatactcttatattatatcaatgtctttttctttacttatttgtctttgctcataaatttctacataatggtagtaatggtgatgaaatgttgttacttgtgatatattacatagtttttacaggcatattctatctgatacctgccaacctgttggtattcatatggagattgatatctagatcatcagtgctttcctcaatgttgttgagacgtttttgctgagagtctaattctttaccagtggtcaaggccattttcttcaatctgttgctaacctgctgaatctggtccaaattcctatcaatttccaattccatttcgtcatcttcttcatcattctcaaactgatatctctttgccttttctagaacattcttcctctgatatctttcccgcacctcacttatgttattatttgcgttcatagcaccctctattctttgagtggactgagacaattgttgacttgtttgctctctcattaatttttcttcaattttcctattcttcagctgctcttccctctcccttctccttctcttggaattaaacggattagaaacatggacagccaatatactacggttcaatttttttagttctgcaactttttcatctgcaactttattttgcaccttcattaaatctaagtttccttctacgttattcaattgttcactttgatgacccagcatacccaatgtgttcatacctgctctttcggcgtcttgagccatttttagtgtatttctagtagaggctacggaactctgtttcgtaaatttgatctcctgcttgatttcatctactgcttcatcttcttcctgctgctggcgagcctcctcttctttttgtatttcttcaaatgttttgtaacccctttgatctccatattggttatttgttgcgttaaagtgttgctgttgctgttgctgctcatccatgaaccactgttgctgctgctgctgtcttgaactatgatcaacttcggacgcatttaaatctattgaatcttcattcgtcattactgcattcaaatcaggctcatctaatgccgctctattttctgcagacttgtcagcataaacttcttcaaaatcaaattcacctgttctaggttcttcatttaaatcaacttcactattgcgtgctgcttcatcagaagcaataaaagagggcgtataagtcattggagcttgttgcgattgcggttgacgcacacttctactagaatatggatttgcagacctgttcaaatttccattactatatgagtcgttcgccatagaggcgtatggatttgcattcttggagcttccttgtcgagtaccgctagatctattagtattggagtcatacgccccgccataactattcatatcagcgtaaggatttctcttttcttgcatcgggtttgctaagggacttctttggtcaagcgataagctgttggtcgacgttgaaaccggcggttgccttgtttgcctcgaaggccctacgtttaaagtgctgtttgaatgatttaaactattacggccattcgcattcacccagctgtttgaagtattttggttactatacgggccatcgttattatatgaattcagagatgtgccattgtacccccctccataatcaccataaggcgcagcattgacgctacctctcccattacttttattagcttgaaaccttgcataaggatcgtcatcatatcggtaatcatcattttcgatagcgtacggatcttgcatagaattggattctgctccatttccgagatcttgcgtgccacttgaacctctattagaaccagcagttgcctcgttagcattggcatctaagggagaagcattcaaatcctcaagttcatcctgtggcctagcatactgctcataacctggtggcgcgtataccttatcttcagctttatcatttgcaaatttaccgtaggcggcaaatttctcttttcttttcttgctagggtttttgacactaatacccagttccatcaaagtatccttgttctgttctggtgtcgcttcctctggaggcttaatcttaaaaaatttctttaatcccattcttttggtgtcaatggtgtattattccgagttactccaggctaggttcaggagtaccaagaatgtactttatttatttatacaccggagcaagtcatataattacgcaaacgattcgaaattgttaaaagcaggatcaacgtatctcatttctttttgaaagacgggtaatagaaagtctctgagtcgcaccccacatggatatcgtactattcgtatatggaatgtaaaatactcgcaatacgattttatttagcttcacaatctctcaaacttatcgtcttgatcaatctttacgttttaccaaataatcgcctgtttctggccattttttgcttataccatctaccatactcgctgtccatatgtgacggtgtcgtctccaagaaaaataacaatgtaaattgacccagcgtgacgacagtagactgtaagttatagtacaatcatactctaccttagtcactgttcctccactgttaagtagagagagagagagagtttaaagtggagaaggcaagaaaaagtgcacttattacgtaatggatcccaccaaagcacccgattttaaaccgccacagccaaatgaagaactacaaccaccgccagatccaacacatacgataccaaaatctggacccatagttccatatgttttagctgattataattcttcgatcgatgctcctttcaatctcgacatttacaaaaccctgtcgtcaaggaaaaaaaacgccaactcaagcaaccgaatggaccatattccattaaatactagtgacttccagccactatctcgggatgtatcatcggaggaggaaagtgaagggcaatcgaatggaattgacgctactctacaggatgttacgatgactgggaatttgggggtactgaagagccaaattgctgatttggaagaagttcctcacacaattgtaagacaagccagaactattgaagattacgaatttcctgtacacagattgacgaaaaagttacaagatcctgaaaaactgcctctgatcatcgttgcttgtggatcattttctcccataacatacctacatttgagaatgtttgaaatggctttagatgatatcaatgagcaaacgcgttttgaagtggttggtggttatttttctccagtaagtgataactatcaaaagcgagggttagccccagcttatcatcgtgtccgcatgtgcgaattagcatgcgagcggacatcatcttggttaatggttgatgcctgggaatctttacaatcaagttatacaaggacagcaaaagtcttggaccatttcaatcatgaaataaatatcaagagaggtggaatcatgactgtagatggtgaaaaaatgggcgtaaaaatcatgttattggcaggcggtgatcttatcgaatccatgggcgagcctcatgtgtgggctgattcagacctgcaccatattttgggtaattatggatgtttgatcgtggaaaggactggttctgatgttaggtccttcttgctttcccatgatatcatgtatgaacacagaagaaatatccttattatcaaacaacttatttacaatgatatttcctctacgaaagtgcggcttttcatcagacgtggaatgtcagttcaatatcttcttccaaactctgtcatccgttacatccaagagtataatctatacattaatcaaagtgaaccggtcaagcaggtcttggatagcaaagagtgagtttattacaactctgatactgcagcagttcaaatttaccactttcctcttcaaggtgcatagaaaaaaagttcctggatgcacgatttaaaatgtttacagcagagcaacaatcatgtgaacaatgtcaaacatttattttaacacttaataattataatataaccacaccagcggtaagtttcataaggaaaacctttcagacaaacattccagtgaatcgtatacgtaaatcagcaaaattagcttataaaatacagaatccgaagatacttgatctactcgcgttactattaatgcgggtaatgatctatattgaattttgcacgtctatagtaacttaaaagtcttgtaatatttgaagtaacaatgccgtataatactgcataatagccctatcaatcggaatataccaaaacatcctttatgtcctgttctcaaaataagacttctgtcagtctggcctggcgtgaatgcatatccatcgcttccgtcctaattggcgcgtatgcatcatacaaatactataagctgttcaaaacacgcgatattccacgtccaaaagaaggcgttgaagaactcataggaaacactcctctggttaagatcagatctcttaccaaggctactggagttaacatttacgctaagttggagttatgcaacccagcaggaagtgctaaggatagagtggctttaaacatcataaagacggctgaggaattaggcgagctcgtcagaggtgaacctggctgggtatttgaaggaacaagtgggtcgactggtatctctatagcagtggtctgtaatgcgttgggttatagggcacacatttctttgcccgatgacacatcgctagaaaaattggcattactagaaagcctcggtgctactgttaataaggttaagcccgctagtattgtcgatccaaaccaatacgtaaatgccgccaaaaaggcatgtaatgaactaaagaagagtggtaatggaataagagcagtttttgccgatcagttcgaaaacgaagccaactggaaagtacattaccagaccacaggcccagaaattgcccatcaaactaagggaaatattgacgcattcattgctggctgcggtactggtggcaccataactggtgtggcaaaattcttaaaggaaagagcaaagataccttgccatgtcgttctagcggatccacaaggatctggcttttataatagagtcaactatggcgtgatgtatgactatgtagagaaggaaggtactagaagaaggcatcaagttgacactatcgtagaagggattgggttaaacagaatcactcataattttcatatgggcgaaaagtttattgatgaatcaatacgagtcaacgataatcaagccattagaatggcaaaatacctatcggtaaacgacgggctattcgtggggagtagtacagctattaatgcggtagccgctattcaggttgcaaaaacgcttcctcacggctcaaacattgtgattattgcatgcgacagcggttcaagacacctaagtaaattctggaaagaagctaaagaaatcgatcacgacgtgtcattagaagaagtaataaatatctaacatagatgtataaatcagtactgagttatcttctattaaattgtaggaacaaatataaaaaagcagttttcgctgctacattttttgctactttccgtggtaatgatgcccgctaaaaagtgcaaaagtaattagatagatcaagaacaaaaacagaccaggaccaaaatcaagctcataaaagttccttaagagtacgtcgatttacagaacatgagggatattgtatttgtatcaccgcagctgtatttgtcatcacaggagggttggaaaagtgattctgccaaaagtgggttcatccctatcctcaaaaatgatctacaacgttttcaggactcattaaaacatatagttgacgccagaaacagcttatcagagacactgctaaatagcaacgatgatgggagtatacacaattctgaccagaatactggtttgaataaagacaaagaggcttcaatagcagataacaatagtgctaacaagtgcgccacaagctcttcccgttaccaagagctcaaacaatttcttcccatttccttagaccaacagattcatacagtatctttacaaggtgtctcttcatcattttctcgcggacagatagaatcattgctagaccactgtttgaatttagcgttgactgaaactcaaagcaattccgcattgaaagtagaagcttggtcttctttttcttcgtttttagatacccaggacatttttataagattcagtaaggttgatgaagatgaggcatttgttaatacgctgaactactgcaaagccttattcgcgtttattagaaagctacatgaggatttcaagattgagttacacttggatttgaacacaaaagaatatgtcgaagaccgaacaggaactataccgagtgttaagccagaaaaggctagcgaattttattctgttttcaaaaacattgaagatcaaacagacgaaagaaattcaaagaaagaacagttggatgactcttccacacaatacaaagtggatacaaacactttaagtgatttgccatcggatgctttggaccaattgtgcaaggatataatagaatttaggacaaaagttgtcagtatagagaaagaaaaaaaaatgaaaagtacgtacgaggaaagtaggcgtcaaagacaccaaatgcaaaaagtttttgatcaaataaggaaaaaccactcaggagccaaagggagcgccaatacagaggaggaggatactaatatggaagatgaagatgaggaggatgacactgaagacgaccttgccttagagaagagaaaagaagaaagagacctggaagaatcaaatcgtagatatgaggatatgttacaccaattacattccaatacagagcctaagataaaatccattagggctgatatcatgagtgctgaaaactatgaggaacatttggagaaaaatcgctcattatatttgaaggagctattacaccttgccaacgacgttcattacgaccaccatagatctttcaaggagcaagaggaaagaagggacgaagaggatagagctaaaaatggaaatgcaaaggaactggcgcctatacaactatcggatggtaaggccatatctgcagggaaggctgccgccatcacccttcctgaaggcactgtgaagagcgagaactataacgcggacaagaatgtgtctgagagctcagaacacgtcaagatcaaattcgactttaagaaggctattgatcactcagttgaaagctctagcgaagacgagggatacagagagagcgagctacctccaacaaaaccctccgagagaagcgcggcagaggaccgtttgccatttacagcagatgaactgaacataagactaactaatctgaaggaatcgcgctacgtggacgaactggtgcgtgaattcctcggcgtctacgaggacgagctggtggaatacattcttgagaacatccgcgtgaaccagagcaaacaggcccttttaaatgagctaagggagactttcgacgaggacggggaaacgatagctgatagactgtggagtcgtaaagaatttcgcttggggacctgaaacagaagggccttggcgcgcgtcccaaaagggaaaggctcgctctgaaacaggcgaagacacgaaaacaaattaccgtttcggggcgttttgcagcaagtggctagacacgtcgggcgttgccagatcaaaatagcaccagtgggtgtttttttactatctcatcttcgtgctgatatatataacttttatacatttccatagtaccaagttctttatttcctgcatttttacatttataatagattaccaaaactattcgacctcaccaagggaccccataatattgctaaaataatcttacctgttttttaccatttttttctttttttccagaagtaataagctctctcttagaagaactaaaagcatctgacttcggctcgttccaaccgaccaaaatatttgtgaaaatattattcattcctttaacgacttattgtgtattctgttcatctctagctggcttccacctcgtttcctatttttattgacttttcattaggcttcctaattatacccatctatgcagtttccattcgcttgtctcctatcgacccttgtaattagtgggtcattggcccgggccagccccttcgactttatattcggcaatggaacgcaacaagctcagagccaaagcgagagtcaaggtcaagtttctttcaccaatgaagcttctcaggatagttccaccacctctttggtaacagcctattctcaaggtgttcattcgcaccagtctgcaacaatagtgagtgccacaatctcttccctcccatctacttggtatgatgcgagctccacttcccagacttctgtgtcatatgccagtcaagaatccgactatgccgttaatcaaaactcttggagcgcgtctactaatcaactgccatctaccagtacgacaagctactatgcgccaaccttcagtacatcggccgattttgctgcttctagtgtaaatgcagcttctgatgtctccactgccagtgttcccattgatacgagtgctaattctatccctttcacaactacaagtaacatagagactacaacgagtgcacctctcacttcggacactccacttatttccactagtacgatgtccgcagctgataacgtattttcgtcagcaaaccctatttctgcctccctaacaaccaccgatagttcagaaagttttgaccaaacttcgactgctggtgccattccggtgcaaagttcagcagattttagtagttctagtgaaattttagtacaaagttcggcggatttcagtagccctagttctccaactactaccgatatatcgctatcagctgccccactgcaaacaagtgaatcaagcagttttaccactgcatcagcagctctaccagtaagttcaacagacgttgatggctcaagcgcctcacctgtagtgagcatgagcgccgcaggacaaatagctagctcaagcagcacagataatccaactatgtcagaaaccttttcgttaacatctacagaagttgatggttccgatgtttcatcaacagtgagcgcattattatcggctccttttttacaaacaagtacttccaacagtttcagcattgttagcccatcggtatcttttgttccatcacagagttcctcagacgttgctagctccagtactgcaaatgtagttagttcatccttttctgatattccaccgcaaactagtacctcagggagcgtagtttcggtagcgcaatccgcatctgccctcgcatttcaaagttcaacagaggtatatggtgccagtgcctcgagcacaatgagttcattattatcaactacttcgctacagtctactactttggatagctcaagtttagctagctcctctgcgtcgagttcagaccttacagattatggcgtctccagtacagcaagcataccgctgttgtcagcctcagaacaagcaagtacttccagcagttttagcgttgttagcccttcggtatcttttgttccatcacaaagttcctcagatgttgctagcaccagtgctccaagtgtagttagttcatccttttcttatacttcactgcaagcaggtggctctagcatgaccaatccctcttcatcaactatagtatattcaagtagtactggcagttctgaggaatccgctgcatctacagcttctgcaacactgtcgggctcctcgtctacttatatggcaggaaatttgcaatcacagcctccatccacttcaagtttgctttcggagtctcaagctacaagcacttcagctgtgctagctagcagttctgtttctacaacttcaccctataccactgcaggtggtgcatctacagaggcctcatccctcatatcatctacatctgcggaaacttcccaggtaagttattcacaaagcacaactgcattgcaaacttcctcattcgcatcgtcttcaacaacagaaggaagtgaaacatctagtcaaggtttttctaccagctctgttttagttcaaatgccttcttcgatttccagcgaattctcaccctctcagacgacaactcaaatgaattctgcaagctcatcatctcagtacactatatcatccactggtatactttctcaggtttcagacacatcggtgtcttatacaacttcaagttcgtctgtttctcaagtttcagacacaccagtttcttatacaacttcaagttcgtctgtttctcaagtttcagacacaccggtttcttatacaacttcaagttcgtctgtttctcaagtttcagacacaccagtttcttatacaacttcaagttcatctgtttctcaagtttcagacacaccggtttcttatacaacttcaagttcgtccgtttctcaagtttcagacacgtcagtaccttctacaagttccagatcgtccgtttctcaagtctcagacactccggtgccttctacaagttcaaggtcgtccgtttctcaaacatctagctcactacagcccaccactacatcctcccaacgtttcaccatttccactcatggagcgctttctgaaagtagttctgttagccaacaagcttctgagattactagctcaatcaatgcaacagcttccgaataccatagcatccagacaaccgcggctactcaatccacaactctatcttttaccgacgcaaacagcagttctgcttccgctccattggaagtggcaacgtctacgccaaccccatcttcaaaggcatcctctctgttgcttacaccatcaacatcctctttaagtcaggttgctacaaatactaatgtacagacgagtttaacaacggaatcgacgaccgttttagaaccatcaacgactaacagttccagtacgtttagtctggtcacttcaagtgacaacaattggtggattccaactgagttaatcacgcaggcaccagaagctgcatccactgcatcttctaccgttggaggaacacaaactatgactttgccccatgcaattgcagccgcgacacaagttcccgagcctgagggctacaccctaatcacaatagggttcaaaaaagctttgaactacgaatttgttgtatcagaaccaaaatcatcggctcaaatcttcggatacttgcctgaagctctgaacacaccttttaagaacgtattcacaaacattacggtactacaaatagtgccattacaggatgactcactcaactacttagtaagtgttgctgaagtatactttccaactgcagaaatagaggagctgtcaaatctaattaccaactcttcaagcgctttttacacggatggaatgggtacagcaaaatctatggctgcaatggttgattcctcaataccgctaacgggcctcttacacgatagtaacagcaactctggcggatcttcggacggatcctcctccagtaattcgaactcaggatcttcaggttcaggatctaattcgaactccggtgtgtcttcatcttccggaaattcctatcaagatgccggtactttggaatattcatccaaatctaactccaacgtatccacttctagcaaatcaaagaaaaaaatcattggtttagttatcggcgttgttgttggtggatgcttatatattttattcatgatttttgctttcaagtatatcataagaaggcggattcaaagtcaagaaattatcaagaacccagaaatttccagtatcagttcaagtgaatttggtggagagaaaaattacaataatgaaaagagaatgagcgttcaagaatccataacacaatctatgcgaattcaaaattggatggatgatagttactatggtcacgggttgacaaataatgactcaactccaaccaggcacaatacatcgagttccataccaaaaatttcaagaccaattgctagccaaaactccctgggttggaacgaagtttgatagcaatgtctgcagagactttctccgcttgcataaccttataaacttataacgatacctacttatttcatatcttatgtatagttctccttcaaggagacgttgttttaatacttttatctattccatttatcattatctactttgtaatcaaagatcgaagcactgctgtgtgcgttgatttgggcctgacacgagaagaaagtgcgttacgtacatcaagattttattcaaaatccagcgtctcctccgcaaaaaagttcagaatacatttgaatgagtcctctggattctccaacagtaaattatgcccagtattaaattctcggacatcagcacagggaaagttatacctcaggagggaataatcattgttaataaagttagactgcaggcctttcatgaataaaactttacgactggctgtgcctttttggaagaagtccctttggttcgatagatccggccattttttcacttcatccaacaggttcggcatgctggagagaggcattgagtaatttatataaggatcatgctgttgttgttcatagtgtaactgtgcttggtgtacattattggattttacagaaagaaaaccgttggcaaagtagagtgccacagctccaccacatttcctcttattacattccaaacttttgaaaagctcaagaacttttttctgccagctgggggaacctcttaaaatcttgacatctctgcggataatccgcattattaagtcatagttttgtaatatcatgggatctaattctggggtttcataaggcggtaaatcaattgatatacactttcgtatattaatattcttgtacaatgtggttaataatgcaattttaccacccatagagaatcccagtaaataaataggtctctccaagccaatatgagtttcaataaaataaatcaaatcattggtcagtgtagtgtagtcataaggtattgcttttggtgaaatgccatgatttcttacatcaacagaaaaaatatccgcgtcaagcttccttgaaagaagcttattgagagaatgaaacatcacgtgtgagcccaaaaggccatggatgttaataattgcaggtctttgctcgaattttattagcgatgaaacatctgagggtaaacgcgttctatggaatgataaatcgacaattattttataaggtagcgctttattatgcgctagtctcgacatttgtaagccctcttcccacggttccttttattttgcagtttgtatacgtctcgaccttggcatgagacaaaaacagtttccccaaaagacgcgctgtggtattcagtaaaggctggtttctatgataggttgagtttagaataatttttaaacaggatactaagataaagcaaatatttcaatcatgtccagattaagaagattcaatagaaagatcttaagcttgagttctgactacactcatgacggtgaatctgatcaagaagatgtatccatattaccattagatacagaagagcaggaagaactcatacaaaaatttgagactaatgctcacatcacaaataagctgtacataaacctgttaagcatattgtatttgctatatggcggactgctaatgatactcgtaagaaaatcgcgagggtatattaagttagcacttcttgctggcgctaattctttgatctgttcgtgcatcacacttagatatgatattgtaaacgactatcttttgttcaaaaagtttaagttaagagtgagcaatttttctattaacataataaacattattttactagtacttatggcttggataagtttcaatcatgtggtcgaagataaaaaaacggtgctctgtttgcaagttccaatgtttttattctgggtcgctgtgcttgtgaaaagatgggctcgaaatatcgaagatgaaatcgcagatctaagatgcttgaaatacaaatacaaaaatgcttagttctatatcgcgacgtattgtaatattcattggttagtatattccggaatatttattactaatattacaaattgattggttggcagctccttatttgtgaacaaggccaaaaagtactgctacgagcttattcaagcatacatatatatagctttaattccaaaatcatcgtcacaggaatctgctttaaaatccagtaaaagactaacctagtcaaaggggacatagaatagcttacaagaggattcagtttggagctaacactttcttcggaactttccagcttcgtacaaaagtgcagatacgttaaaagatcagtttatccgtatgttttgaaaaggctatctagtgcagaagtctctaatttcaatataatagcttgctaaatagtcttcgaggcgttgcatatctatcaagaaaacaacatgaccaatgtacctagaattataattaagtagatgatgccaatgaggtgagcgagcaaaaccatgtcaattggatagtatgaataaaccgccattaatcattggtgacacgcctgttatgtctttctaaggtacataaaatacagcagtgataatgtcgattacgtccaagaggaatgtttagcaatattgccgtcacattaacaatactaatcttctcgttgcggtccattcatttccgcggagtttactgtcgaaaggttttttttttttccgcagcatttggaaaacaattgatgtgagtaatttagaacaaaatatacggcagtaatctcccaaatttgcgatactaccacaattcaagatcgtgcgcgagagtaagtcgagcacggtgctgtatattttcatacattatacattcgaggacctttcaccaaacaagaggaacttagctgatactaaacgaagattagaaaaagagcaaaaaaaaacaaaaaaagaaccaccgaaacattaaaagtgggaataatgtcgcatcaaatggcgccatggatacccatgtttattcaatcgtgcaaaaataacactgaaccgtttgtatcatttcaatttgctactgttgacgaactaacgaacaaaccacgttgtagaacggtagtgttcagagattttttatttcatgacaaaagaactaatgtgttgacttttaacactgatatgaggagctcaaagataactgaatcatttataactccaaattcaaataactctagcgacagcaaaagatgtgagactccatttttcgaagcatgtttctatttcccggaaacttgggagcagtatcgcttcagtggccaatgctttacaatatctaaacaatttaagaaaataccggctgagattgtaaccaagtatgacatattttcaccgcggttttcagagacaaatgatgacagcactgacgaagaaatagatactccaattaacgacgacgacgacgacgataaaaataatgacgccgacaataatgacattaacgaagataacaaacttatagaatccatagagaacgatgaacaccatgaggatgaagacgactactaccctcaaccacaagaatgggaggctgaattactaagacaatggtcctctctatcaaggcataccaagtcattgtataggaagccagccccgggccagaaacttacctctgaaactagcaaacaactggacaaactccatagaggagttgacggtgctaaagaggacgctggactggaaaactttggtattgtctgtctttgtgttgattctgttgattttttgaacttgaaagagggaagaggtggtgaaagatggattttccagaaaaccgacggcaaagacgaagatctgtgggaggaacaagaagtgtgtccgtgagaaatgtcaatcattattgctaacgttcgcgatggttaatgctttgtattcgcgctatctcgatttctacctatatagttaatctctgtacaaaaacaatctttccaactatccattaatcatagtatattatcagcgtcggcgattttaccacgcttgacaaaagccgcgggcgggattcctgtgggtagtggcaccggcagttaatctaatcaaaggcgcttgaaggaagagatagataatagaacaaagcaatcgccgctttggacggcaaatatgtttatccattggtgcggtgattggatatgatttgtctccagtagtataagcaagcgccagatctgtttactgtaaaattaagtgagtaatctcgcgggatgtaatgatttaagggaatctggttcaggttttcacatatatttgtatataaggccatttgtaatttcaatagttttaggatttttccttctcccaaaatactcacttactgtgttacattacagaaagaacagacaagaaaccgtcaataagaaatataactaagaacaatgtctatttgtgaacaatactacccagaagagccaaccaaaccaactgttaagaccgagtccattcctggtcctgaatcccagaagcagttaaaggaactgggtgaagtttttgacacaagaccagcatattttttggctgattatgagaaatctttaggtaactatatcactgatgtggatgggaacacatatttggatttgtatgcccaaatctcttcaattgcacttggttataacaaccctgctttgatcaaggcagcacaatcaccagaaatgatccgtgctttggtcgaccgtcctgccttaggtaacttcccatctaaggatttagacaagatattgaagcaaatattgaaatctgcgccaaagggtcaagatcacgtctggtcagggctttccggtgcagatgccaatgaattagcgttcaaggctgcctttatttattaccgtgccaaacaaaggggctatgatgccgatttttctgaaaaggaaaacttgtctgtcatggacaatgacgcccctggcgcccctcatcttgccgtactatcgttcaagagagcgttccacggtagattgtttgcctccggttccacaacttgttctaaaccaattcacaagttggatttcccagccttccactggcctcatgctgagtatccatcttaccaatacccattagatgaaaattctgatgcaaaccgtaaagaggatgaccattgcttggccattgttgaagaattaatcaaaacctggtctattccagttgctgccttaatcatcgaaccaattcaatctgagggaggtgataaccacgcttctaagtatttcttacaaaagctaagagacattaccttgaagtataacgttgtctacatcatagatgaagtgcaaacaggtgtcggagccaccggtaagctatggtgtcatgagtacgccgatattcaaccacctgtggatttagtgaccttttccaagaaattccaaagtgcaggatatttcttccacgaccctaaattcattccaaacaaaccatacagacaattcaacacatggtgtggtgaacctgcaagaatgatcattgcaggtgccattggacaggaaatctccgacaagaagttgactgaacaatgttcaagagtaggtgattatttgttcaagaaattggagggtttgcagaagaaataccctgaaaactttcaaaacttgagaggtaaaggaagaggcacattcattgcctgggatttgcctactggtgagaagagagacttactattgaagaaattgaagttgaatggttgcaacgttggtggatgtgcagtccatgcagtgagattaagaccttcattaacattcgaggagaagcatgctgatatctttattgaagcattagccaaatcagttaatgaattatgattgtatattagcgaggccgtgtcacgttcccttttttggtctttatatatgtgtatcttgttataattttaaagaaaagttttatattactcatcagttgtgtgtgaaaaatatgggcgggtattcacaataggaaaaaaaaaatgggtttggtgactgcagtaaagacgtgctaaaaaaaaaagttgtttttatctgaaccttaaatatatcatttatgagtgtatatattatacaaacgcaataacagtggctcccgccctccacctccgcctgctactagtaatctaccagtaattgtgtttgttttgggaaagatcgttcgcttactcaccgaacaactttctgactctcttcaatacagagtccttttcagggtcgtagggatgatctttagatggaatttctaaaatagcagggaacgcattggtgaaggagtccactctagctcttatgttttccgcgatatgttggttgattagaaggatggcaatatcgtctctctcttcagtaaagtgattaaacttgtcagtgatttcctccttagtagtcttaccttcttggtaaacaaaaaagttcttttcttgggtttcaggagtgatttgtccaatcccggctaacaataaaccagttgtagtatcttcgtcagctatcacagctataagagtacgtttctcagccatgatttagttactatgcgtcagtgagactagctatgaatatagaaatgtagtgctctattttcttaattctttgtcaactcgatataataaatgtagtgcttgcaattcacgttggttttcctgttatcgttcgtcctttattttttttttctttcgttttcctacttccctttaccggcgtaagcgcagtgaaatttttttagtacgcacgtacgcaagtttcagcagcaataaggggaaagatgatgataataactaagaaaaacagcaaacttggtatgaacgcatcaaaaattggaaaatgttggtaagaaataggtatctgggtgaactgctcaaaaactctcgatcgtttagtgtgctgaattcctcggtacgttcaggtcacaacaaatggtcaaccatcaagcacggtaaagccaagaatgatgcggaacgaaacaaaattaataacaagtttgcaaaccagatagcaatgtcagtcaagttaggcaacggtattacggatccgagcatgaatataagattagccaccagcatcgagctagcaaataaaaacaatgtcagcaaaaaagttattgagaacgccatccggaaagcttctggaagcagcgcatcgggcaaggactcaaacgcttctgagctatgtgtatacgagggaatggggcccggcggggtcgctatagtggtggaagcgctgacagacaacaagaacaggaccataggtctgataaggagtgcatttaataaagctaatggatcgatgactccaacgttgtttttcttcgacaaaaaaggatacgttacaatggtacctccgaagatgttagacactgaggacaaggtgctagaaagcgtactggagattcaaggcatcgaagacattgcgcctgtgcaggaagacgcagaagatttagagtgtgataccgaaactgaaactacaggccaaacttacgaggcggtgatggaacctgccgataccaataaggtggccgccctactgaaggagcgtggtttccacatcagagacttgggcatcggctacaatgccaagccggatatggaagttttcgtgcaaggcgatgaaacgctcgagaaactacagaaactgaccacagcgctcgaggacatcgacgaagtgacgtcgttgtacactaacgctagcaacgcttaatccaaccaaaccgtaaataaataatcaataccacaaatacctgtatatactaaacaaacagtagtaataactgtaataaagagtaaaaacaacaacaaagacaatcgtacgtaaaaacaccaagcggacaccagcacttgcctgctgcggactgttgtctgcggactggcgggggtcgagcaagaaccgacgaagtaaccgacggaaggcgggcggagacggagacgcagccgagatctatttttactcagcggtaatattagatcatggctagggggatctggaagtacaatgatgtgctctccccctctcaaacacaacaccaggatgaactaagggctcatctcgaaagtcgaaggtgcctcattcaggttattagtggtgcctgttgtgtcttccatgaacaaggagcacttaattacttgttgttgcatgagatatcatttttttttttccctctttcttggggtcttgacagtcatcaaatcgaagtttttagtttttcttcttcgggaagatcaattttaggtagaaaagtgtagatgaaaaacgaaggatactgctatttactgtaagtactcttcggtccatattggaagaccaaggcataataaggatatattccgaggagataattgggatataatcctccattgcttccgaaatttgtttaaacacttctagttcatttcgggttggttcgatcttcgtttccacttttaacttactcccagttagtataatataagtagttaaggtatggcaagctgcaatccgaccaggaagaagagctctgcttcaagcctatctatgtggagaacgattctcatggcgttaacaacactaccgctaagtgttctttcgcaggagttggttccagctaatagcacaacatcgagcacagctccttccatcacttcgctttccgcagttgagtcatttacgtccagtaccgatgcaacgagcagcgcaagtttatcaacgccgagtatagcttcagtatcctttacttccttcccacaaagttcttcactgcttactctttcgtcaacattatcctcagaactttcctcttcgtccatgcaagtttcgtcgtcttcaacatcgtcgtcttcttcggaggttacgtcatcatcgtcatcatcatcaatatctccttcctcttcatcatcaacaataatatcatcgtcatcatcactgccgacattcactgtggcatcaacatcttcgacagttgcctcctccacactttccactagctcatcgttggttatctctacgtcttcgtcaacgtttacgtttagttcggaaagttcaagctctttgatttcctcttcaatttcaacatccgtttcgacttcttcagtgtacgttccctcctcttcaacttcatctccaccttcgtcctcatccgaattgacatcatcctcgtactcatcatcctcatcctcatccaccctcttttcctactcctcctcattttcatcatcctcatcctcatcatcctcatcatcatcctcatcctcatcatcatcatcatcatcatcatcatcatcatcatcatcatcatcatcatccatatccttatcctcatcctcatcctcatcctcatcctcatcatcatcatcatcatcatatttcaccctctccacatcttcctcttcatccatatactcgtcttcgtcatatccttcattttcatcttcatcttcctcaaaccctacctcatcaatcacttctacatccgcctcatcttctattactcccgcttccgaatattccaatttggcaaaaaccataactagtataatagaaggccagaccatcctctctaactactataccacaataacgtattcaccgacagcatccgcatcttcaggaaaaaattcacatcactcaggcttatcaaaaaagaatcgtaatattatcatcggttgtgtggttggcataggtgcccccctcatcctaattctactaatattgatttacatgttttgtgttcagcctaaaaaaacggatttcattgactctgacggtaaaattgtcacagcttatcgtagtaacattttcaccaaaatatggtatttcttgctgggtaaaaaaattggtgaaacagaaagattcagctcagattcccccatcggcagcaataatattcagaattttggtgatatcgatccagaagatatacttaacaatgacaacccctacacccctaaacacactaatgttgaaggctacgacgacgacgacgacgacgacgctaatgatgaaaacctatcatccaacttccataacagaggcatagatgatcaatactcacctactaaatctgcatcatattcaatgtcgaatagtaatagtcaagattacaacgacgcagatgaagtaatgcacgatgaaaacattcatcgtgtttatgatgacagcgaagctagcatcgacgagaactattacacgaaaccaaacaacggcttaaatatcacgaactattaaatcatagcgaaagcagctttgccataacttttcttcttaaaatcaccctcggtcatttcgttcttctttttccgattcaattcctaataatttatgcatattacagaacttttttttccctttttctgtcacaggtttcccaatttttttgacgactaaataataacataaccactacgttcacttccccgtatatatacatatatacttaatattataaacgcatatacttttataaacttggaataagtattatatatttattttgaccatccggaaatgctttattttacacttggaaagaaaagtgcatttggaaaacttttacatgtcacccaagtgcatactgctgacgatacaggtttagagactaaagagagcgcatggaagaaaacttcaaaggaagagaagaaggatcgcagagttcaaaggaactcttaatttgggcccatcttttgaaaatattgtctctgcaaaagcttcgaacaccattttggatcctctggagaaggcaagacagaatgcagaggaagctaagaaattaccttgttagcttaaggttcctgttcctaagggtagcggtcaccacaaatggaaaagcgactttcccaatgtaattatttttgtttgttccgcaagtatctaacaatatgatatattgctagttgaaaatcgaacactcgagttacttccgtgatagtttaatggtcagaatgggcgcttgtcgcgtgccagatcggggttcaattccccgtcgcggagatattttttatcatcacaaaaataagatagcaaaactgaagaaacgatgagttagttttaacttttaaaagatcgtccaatattaacataaaggaacccagttctttggaaataacaggaaagtgcagaaagttcattagaaatcaacgatgatctgatatacatatatatatatatatatatatatatataannnnnnnnnnnnnnnnnnnnnnnnnnnnnnnnnnnnnnnnnnnnnnnnnntcattattgtagtttatcccacattcagaaaatagtatttcctgtttctcattactaaatgttccacatagtttcttctcggattcctggggagttaagccacactttattattaactgccaaaacgtcgtattataaagattgtttatatgtgtatcgacatatctccaggataaataatcttttatcgtttgtaaattagggtatgctacacaccttgaatcgaaatatggcaaatgcttgatattcaacggcttttctgggaaaaacttggcccataatgcgacgtaattggacgtgaaaaaagaaccaaataaagtcgcaagcttgtctttccttctgttaaataaagttgtacttgacttcaaaataaatgagtattcgtcactctccccgaacgccaatataatatcatttttgtacttgaggacaaggttcttagcacatgcattcattaacttcaaagcattttcatcgtttggcttggcaaactcgtagaacttggaaaattcatgaaacttcttgccgtctattcttaccacaatataacactgaggcaaaataacatcgtgtgtttcaaattgccttacgtatccaaatttagagtttgccatcccgctcgcattaggaagtagaatctttgaacattaaggcacatgactggctatgagccctttaagtttttctctatccgcatgtcttcaattaattctccatcagtgatttttaaaacaataaaaactttcaatccgggtaaaactgaagaatatagagcgaaaaaagcgtatgtgcaggacaagggatacttacgccaaaaaagaccatgtccattttattataggatacccacttgcacggcgtcaaagtactcaattggctgtgcttcttcaaaaaaactaacatacacaagaaccaaatttaaattcaacttggttacccaaagagagaattcattatagaaagatataaaaattttgtagaaaaaaaacaacaacgttggaaatggcgaagactatcaaagttatcaggaagaaggaccccaaaaagaagaacctatccgatcctttagcaaaacaaaaactagtttggaaaatcggacacgttttaactttagtttttggtttattattttctatcacgtatttctaccatgtcctaatcttcttcaaatatcgttcctggaagtggttgttcttaagggtcaataaaaattactcgtttattcaaagtaagagatggtacatgaaacttttgagttggagcccacaggtaatgtaccgtttgtcattaattggcgtatttatgtctgagtccgtcacaatgcaacagaactgggttggacttaaccctacttggaatgaccttttgtcctctgagaactttcatacccttttgattgcctgtttatggttctttggtggtggtaagtctttttacaagattttgccttacatgattttaagttatctacacctaactaaaatgaactacgaattgaatgctaacaaagaagaaaagatccctttaacacccaaagacagaaaaatgctacacttacttgcgtactctgaattacttgttatcttagcgctaacactagacactatattgtttaagacgggtacatccggatttatgctcgtcatttatgttggtatttattggttgaggttgaacttctctccatacgcacaagtggctgttttggagttacttgtcaagtttgaaaaatacgtccccaaaaaatatagagacaaatggcaggttataaagaactttatttatatgaaaatgaaggagcacgaaaagagaacagaagaagttgccagatacgcgtaagaaattctctaacttaagatgaccagatgtcatgttcgtttacttattttcctctcctcttaccttttttggccactaacgctcgtacagaaatggacggcatacatacaatttaatcaattctcttaaataccgttttatacctcatttctgacttttcagccgttaatgttccttttttttttagactattgtatgtatcacttcctgaatgatgtcttccataacacaaacgtgacgtgcaaataaacatacataaaaatattattgaaaatacagattatttaaaattatataacccgttccctgtttattcagaagcagtagctctggtgtagatagcttgcttggagtgcttggagattggcttgatgataccttccttttccaagtgtctcaaagcaattctagctaaagaaccaccaatctttaatctgtcgaccaaaacagagacagaaacgtatctgtaagttggaacttccttcaagattctgtcgtacttctcttggtctaaaatgacagcgtgttgagctctgtctttcatggactttttggaccacttcttcttagacttcttaccaccagcaagggcagcagcggctttggcagctttagataattgttgctttggaggcatgatttattaaatgttctatgataaagtaaaaagtaaaaacatacttgttagtaaaaaaccgaactctagtagaatttgggataaagactatttgctaatgacttgaattgtagattgaatttaactgtaaatcaccactaagtacgtagtttccttctctcaaagtaccatgggtagctagatctgtgctatggagcatataacagagacatggatattcatcccattaaggtagaacaggcttttatgacatattaaatcctggattggccagtcactatttcatcttatccgcctaatattggtttcaaatttatagatacatacactaaaactaacagggcttgacggttttcgataacaaagaatacgatttcaatattcaactgagcaatcttaatagtattaaatgcttcgtgaactttaagagatacttcgtgaagttgttctgtcgcacaattcttcctgtagaaggcgtccttcgtttttttgtcttcgcgcgttacagggtaaatgaacctctttatgggtgaatgggttacacaaatgcacggatgcatatataaaatatagaattttgctttatattattttgagcgggctagaatccactcagtgtacaaagtactattcattatattgaactgaagaggcaagaactatttagctcaatcaaccaccttaataaagtatttggagtgatatatcggcttgttttagtttaattcttgtggatatttagatatcaaggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaattatctcaacattcccccatttttcaaaggtaatttttggaattccttgcaaagctgtaattaggtatacaaaatacactagatactctactcgacgatatagtaatcctcataagggaatcggtatttctaatattacgttatttttattttcttttactgttttctatgttgtagttcataattccataacattattaatcctagtgcttcagcttccattgaatctgatgactttttctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacattcacatatttctcattctcaatcttcatggtatcttttttacaccgtatatgataaaatacaagtaatataaataccagccactggatgacattgaaattttattctaataaatgcatcagctctttaaaaacattgctatttagctatttgaagccagaaattttcacagattaccatccgatatagtgtaacggctatcacatcacgctttcaccgtggagaccggggttcgactccccgtatcggagtgttctttttcttacctcttgaaaaagaggtagtaaagtcaatataaattcttggctgaagtatttcaatacaattggtcaaggaagttattatttttttaatgacttatatctgtccaacacaacaggttacaccatataatctctatttactggacaggcggaaatcgatagtttagctttcctaaaaatcgttatattatagaagcgtcttgacacgttttcaaaaaaggaagaagcaagaacgaaaagagataaggattcaaaagaaaggaagcccaatgtctcgcaaatttgatttaaaaacgattactgatctttccgtcctagttgggactggcatatcattatactacctggtcagtcggctactcaacgatgttgaatcaggaccgttatcaggtaaatcaagggaatcaaaggccaaacagtccttgcaatgggaaaagctggtgaaaagatcaccggcattggcagaagtaacattagatgcatatgaaaggactatattatcttctatcgttacgccagatgaaataaatattacattccaggatattggtggcttagacccgcttatttcagatctacatgaaagtgtcatatatcccttgatgatgccagaagtatattctaatagccctttacttcaagcacctagcggtgtcttgctatatgggccaccaggatgtggtaaaaccatgttggcgaaggccctagccaaggaaagtggtgctaattttatctcaataagaatgtcatctataatggataaatggtatggtgaatctaacaaaatagtcgatgcaatgttttcattggcgaacaagttacaaccttgtataatattcattgacgaaattgattcattccttagagaacggtcttctacagatcatgaagttacggcaaccttaaaagctgaattcatgactttatgggatggcttattgaataatggaagggttatgattatcggtgctactaatcggataaatgacatagatgatgcgtttttgaggaggttaccaaaaaggtttcttgtttcattgcctggttctgatcaacgttacaaaatattaagtgttttattaaaagacactaaactagacgaagacgaattcgacttgcaactgattgcagacaataccaaaggattttctgggtcggacctgaaagagctttgcagagaagcggccttagatgcagcaaaggaatacataaaacagaagaggcagctcattgatagtggtacaatcgatgttaatgatacttcttccttgaagataagaccattaaagacaaaagattttacaaaaaaattaagaatggatgctacaagtacgttgtcatctcaacctcttgattaaggaaggaaaattagaaaaaaaagaagaaagctttttattcacgcatcatatcatatcagataagctagttttcacataatatgtgtatatgcagtatactcctgtacataacttcctttatttctgctttataattatatactagttatttttcttgggccgcttttattacggcaactattctatcaggtttagtcataatctaaatctaaagatggggaaaagccaaaaacactcaactttcaatgaatacaaagcttcatgaaagcaatagataaaatgacggataatccaccacaagaaggcttaagtgggaggaaaataatatatgacgaagatggcaaaccgtatgttggattacgcaaagcaattcaggatctactgatccaatcaagcttgtgattttttattaacaaattctctataatagttgccgatcatgtaacaccctacttgactttcagtacgtgaccgggaagatatctaatggcctgaagaacctctcatctaacggtaaactagcaggtacgggggctctcactggcgaagcttcagagttgatgcctggctcaagaacatacaggaaggttgaccctcctgacgtagagcaactaggtagatcttcatggacgctgttacactctgtagctgccagctatcctgctcaacctacagaccaacagaagggtgaaatgaaacagttcttgaatatcttctcacatatttatccttgcaactggtgtgctaaagactttgaaaaatatatcagagaaaatgcaccacaagttgagtcaagagaagaacttgggaggtggatgtgtgaagcccacaataaagtcaataagaaattgaggaagcccaaatttgactgtaatttctgggaaaaaagatggaaggacggctgggacgaataagtacaatctcagaattctgaaggaacacataaaagacaatttatacatatttacagattctcgtgtatataacactccaatcgtattgatcagtcatatgttggcttttttatttaggcttgagctctaactttccagatgaatgacttttctactaatatatgttaggattaatagttttatatgtataaaaatatttagtcagtatttagctaaaaagtttactttcaaagaattgtcatgtttgcagctagtgcctctggtcttttgagtattcccagcccttgtttagaggtcatcaagaatgaacttgaaattagccgtatcagtggtattaacctcttctaagaagagcagaaaaagaaaaaaatctccgcgacggggaattgaaccccgatctggcacgcgacaagcgcccattctgaccattaaactatcacggaagaaatatctgtgaaatgtgactcttatagcatactattttagttatgaattgtgaaaatcctccctgtcctgcgttctacaatttatttagtacttgtttggcaaaaacgtctctcagtgccatttactttgtaaaaagtgcagactacatcgcatcaacggtcatattaggagccacttctatttttaactcaacatgatcattcaaaaatgtcgatacacttgcattttattgtacatactagttggaagaggcagcgtcgattttgctgaaatttctagtaacttgtagcagcaatacattatatcataaaaataacctgacttgtaaaagttgaaaccctaacttttattatttctttcaatatttttcgattagacgtgaaagatgaccaagcacaactaacaaaaaatttgcatcctcataaaaagcaagactttttgtatgtcgaaacaaaattattaaaaaacacgcattaacacagacacgaatttggcatactttcattttactttatatctagtgaaaagtagaaattgtttaagggaactacttcacagtgaccactgatactagaatatggaaataagaaaagttgctaagtaggagcctaacaatctttttttatatttttccatattcctttattgtcatgggtcaagactgtatatgttagtgaaagttttagggttcttgtgacaaacttcaccaacataaacatggcctcttcgaagatccgtagattttgcatttttgcggtggtttatggattcaaagcgaggcctaaattaacgatcatgtctttgctattatatcagagggcatatcattgaatttccgatttccaaagggaagaaaataaataaagttgtgctatttccatgcatccttttttctttcattcaatgacacatacttcttgtagtaggaacaattggtagttctgatatcgattaagccttctaaaaatgctttatattataaagtacaaatgcaagaagtagctatggatgctaaagagctggtcgatttattgtttggtgaatgaatgtaggtttaaatcaatgatctctgaatcagaaacaagggtgaccaaaattggaaccttgagcctttcttcctgtagttcatttctgccttctctttttatatcgaacgatgttaatttattccactgataaattttcttattgttcttaatataaccctttttaaatatttccaaaatacttaacattttttgaatatgtggaccgtaagagaatatacaaactacttgttgtagacccaaacttctatctgccatgttgatttgtttatctaacttatttacagacttcttaatgttatcgttcttcgatatgccatgatactgtattgatgtactgttgttaccattatttgctaaggacggtataactgtttctttgagaaaccgaagacattgagtggaggaagagatatccaaatctctactaatttcattgtaatatacgccattgatcattttgatttgcttttatctttttttcttcttcttcttttcaatctcttccaaacaatcttggcctcatcttcatggaatttttcgaaatactcatcagcaagtgtccgatgccttctcaattttttccaagagcgtgcgggggttggttatccagtacatgtgttgcttgaaactgccaacaaaaaagaaaagaaaataagaatatattagtacgccaatagtaaacgtcaccccgaggtttaaaaactaaccgtgatatacgaggagaattggtaacggtacaatgatgatactgggtaaagccgggatcctggcacagtatgggacaatatatgtgagacaaaataccattcggaataatttaagttcctgcatttttaagcagtcactatgtgcctttcattcattagcaaaggtgctgcaacaaaagcaagtcccactggacctttcatatgacataatcaagagagatgcagtaaaaactggggatgaagggaagccaagaccacctattatcatacttcacggcttattcggtaacaagctcaacaaccgaagcattggccgtaaccttaacaagaaattgggaagagacgtgtatctgctggacctaagaaatcatggatcctcaccacacagttcagtccataactacgaagtcatgtcggaagacgtgaaacactttatcacaaagcacgaattaaacaccaatggaggccctattataataggacactcaatgggtggtaaagttgccatgatgctggtcctgaaaaacccgcaactttgttcgatgttagtctgtatagagaacgctccggtgagtttgcgccctaacgctgagtttgtcgaatacatcaaagcgctgatggaaatcgtcaacgacaagggcaaaactatccgcacgctgaaacaggctgatgaacaccttgcagagaggatcggcggcaatgagctagtaaggcggtttctcctaacggcgctgaaaaaggtcaagatggacaattcatcgtctgtgtcgtcatatacattcgaagaacgaattcccctcgcaacactgaaagatgccattgtcaaaggtgaaattgccgcgtggcccctagatcctgctcgtgaacgatggacgcggcctgcgctattcatcagggctactcaatcgcattatgtggtagacgagtatcttccgatcatcggcgcgttctttccacgctttgaaacacgtgacatcgatgcgggtcactgggtaaatgcggagaagcctggggaatgtgccgaaagcatcgtcgattttgtggagcggcacgaggattaaaggcaagcgccccggagcaaggtgccagtagcaccagtcggtggctgtgcgcttgccgtagcacatgacatacggactattgtgtgagtggtgatggggtgtaggcagtgccacaccagtttaaaggcctagtaacggcaaatcgccaaaagagatgatgctgatgcatacgataagatcgtcagtttcacgttcgcggttcgaacatggaattgtggctaaagaaatttgggcggtatgatgcaaatgaggtgtacgtatgtatatatagcaaagagtagaataaaatgagataaagcctcgttcgttctctccatttcttccctgtttctcctttattttctctactgcttatttcgagttcaccagagaacaagagagcaggaacgcaaagagtgtgtgacacgaaattcaagatacaaaaataaaagcttacgttgtgtatttcaactggtgtgctaagaatagagtttcataaagtactgcatttattcatatattatttttgttatttgtatatatacttcacacttagagttctactaaaagtctacccagcacgcatccttcgtttatttttacatctctcttttgcttttccttttttttttggtgcttgctagatactactgaagatcaaaggttacaaagaacgccgcatatattttctgcaggcatattaaagaagttacaaaaggattaatcgaagcgctgtttggatacactcctgtaaagagaagaaaaggaaaaaaataaaaagtggacaataaataattattaaactgtcatagttatgtcctacaacgatccaaacttgaatggacagtattacagtaacggtgatgggactggtgacggtaattaccctacgtaccaagtgacacaggatcaaagtgcgtacgatgagtacggtcagccaatctatacacaaaaccaactggatgatggttattatgatccaaacgaacaatacgttgacggtacacaatttcctcagggacaagatccttcacaagaccaaggtccttataataacgatgctagttactataaccaaccccccaatatgatgaacccgtcttctcaagatggagagaacttctcagattttagcagctatggtcccccatccggcacttatcctaacgatcaatatactccttctcaaatgagttatcctgatcaagatggttcttcaggggcctcaaccccctatggaaatggtgtcgttaatggtaatggccagtactacgaccctaatgctattgaaatggctttaccaaatgatccatatcccgcatggaccgcagatccccagtctcccctgcccatcgaacaaatcgaagatatcttcatagatttaacaaataaattcggttttcagagagattccatgagaaatatgtttgaccattttatgacccttttggactctagatcttctaggatgtctccagaacaggcccttttatcattacatgcagactacataggtggagatacggccaactacaaaaaatggtactttgccgctcaacttgatatggatgatgaaattggtttcaggaatatgaagttgggtaagctatcaagaaaggcaagaaaggctaagaagaaaaataaaaaagccatgcaagaggctagtcctgaagacactgaggagactttaaatcaaattgagggtgataactcattagaagctgcggattttagatggaagtcaaagatgaatcaactttctccatttgaaatggttcgtcaaattgccttgtttttattatgttggggcgaggcaaatcaagtcagatttaccccggagtgtctttgtttcatttataaatgcgcctctgattacttagattctgcacaatgtcaacaacgtcctgatcccttgcctgaaggtgattttttgaatagagttattactcctctttatcgttttattaggagccaggtttacgaaatcgtggatggtcgatacgtgaagagtgaaaaagatcataacaaagttattgggtatgatgatgtcaatcaattattctggtatccagaaggtatagcaaaaattgtcatggaagatggaaccaggttgattgatttgccagcagaggagcgttatttgaaattgggagaaattccctgggatgatgtcttctttaaaacttacaaagaaacacgttcctggttacatttagttaccaacttcaatcgtatttggatcatgcacatctcagtatattggatgtattgtgcttacaatgctccaactttttatactcacaactatcaacaattggtcgacaatcagcctttggcagcttataaatgggccactgcagcattaggtggtactgtggcaagtttgattcaagttgccgctactttgtgcgagtggtcattcgttcctagaaaatgggcgggtgctcaacatttgtcccgtagattctggttcttgtgtgtcattatgggtattaatttggggcctgtgatatttgttttcgcttatgataaggacacagtatattctactgccgctcatgtcgttggagcagttatgttttttgttgctgtggcaacacttgttttcttttccgtaatgccattgggtggattatttacatcgtatatgaaaaagtccacaagaagttatgttgcctcacagaccttcaccgcatcttttgctccattgcatggtttagacaggtggatgtcttatttggtttgggtaaccgtttttgctgctaaatatgcagagtcatatttttttctaatactgtcactaagagatccaattaggattttatctactacatcaatgagatgtactggtgaatactggtggggtaataagatttgtaaggtccagccaaagattgttttaggtttaatgattgcgactgacttcattttgttctttttggatacctacttgtggtatatcgttgttaacactgttttctcggtcggaaaatcgttctatttgggtatttctatcttaactccatggagaaatattttcactagattgccaaaaagaatttattctaagatcttggctactactgatatggaaataaaatataaaccgaaagtactaatttctcagatttggaatgctatcattatctccatgtacagagaacatttattagccatagaccatgtacaaaaattgttatatcatcaggttccgtccgaaattgaaggtaagaggactttgagagcaccaactttctttgtttcccaagatgacaataattttgagactgaatttttccctagagattcagaagctgagcgccgtatttcattttttgcccaatctctatccactccaattccagaaccactaccagttgacaacatgccaacatttactgtattaactccccattacgccgagaggattctattatcattgagagaaattattcgtgaagatgatcaattttcaagagttactcttttggaatacctgaagcaattacacccggtagaatgggactgttttgttaaggatacgaaaattcttgctgaagaaacggccgcatatgaaaacaatgaagatgaacctgaaaaggaagacgctctgaaatctcaaattgatgatttacctttctattgtattggtttcaaatctgctgcaccagaatacaccttacgtacgagaatctgggcctctttaaggtcgcaaactttgtatcgcacaatctcggggtttatgaattattcgagggccataaaattactttatcgtgtggaaaatccagaaatcgttcaaatgttcggtggtaatgctgatggattagaaagagaactggaaaaaatggcaaggcgaaaattcaaattcttggtttcgatgcaaagattggccaagtttaaaccacatgaactagaaaatgctgagttcctgttgagagcttatccggacttgcaaattgcctacctggatgaagaacctcccttaaacgaaggcgaagagccaagaatttactcggccttaattgatggtcattgtgagattttagagaatggtcgtagacgtcccaaatttagagttcaactatccggtaatccaattcttggtgatggtaaatcagataatcaaaatcatgctttgattttttacagaggtgagtatattcaattgattgatgctaatcaagacaattacttggaagagtgtttgaaaatcaggtctgtcttagcagaatttgaagaattgggaattgagcaaattcatccttatactcctggtttaaaatatgaggaccaatccacaaatcatcctgttgcaattgtcggcgctagagaatatattttctcagaaaactctggtgttcttggtgatgtagcggctggtaaagaacaaacttttggtacattatttgcccgtactttggcacagattggtggtaaattgcattatggtcatccagattttattaatgcgacattcatgactactaggggtggtgtttccaaagcacaaaagggtctacatttaaatgaagatatttatgccggtatgaatgccgtacttcggggtggtcgtatcaagcattgcgaatattatcagtgtggtaaaggtagagatttaggttttggtacaattttgaatttcactactaagatcggtgctggtatgggtgaacaaatgttatctcgtgaatactattatttgggtacgcaattacctattgaccgttttttaacattttattatgcgcatccagggtttcacttgaataacttatttattcaattgtctctgcagatgttcatgttaactttagtgaacttgcatgctttggctcatgaatccattctgtgtgtttacgatagggataagccaattactgatgttttgtatccaattggttgttacaactttcatcctgcgattgattgggtgagacgttatacactctctattttcatcgtcttttggattgcttttgtccctattgtcgttcaggaattaatcgagcgtggtctgtggaaggcgacacaaagatttttccgtcacattttatctctatctccaatgtttgaagtctttgctggccaaatctattcttcagcactgttaagtgatatcgctgtgggtggtgctcgttatatttcaacaggtcgtggctttgctacatctcgtatacctttctctattctttattcaagatttgcgggttcagccatttatatgggatcaagatcaatgttgatgttattatttggtaccgtggcacattggcaagctccactattatggttttgggcatcattatcagccttaatctttgcaccattcattttcaatccacatcaatttgcttgggaagattttttcctagactacagagattatatcagatggctgtcaagaggtaataataagtaccacaggaactcatggattggttatgtaagaatgtcgaggtctcgtgttactggtttcaagcgcaaactggtgggtgatgagtctgaaaaatctgcaggcgatgcaagcaggactcatagaaccaatttaattatggctgaaattataccgtgtgcgatttacgcagcaggttgttttattgccttcacgtttattaatgcacaaactggtgtcaagactactgatgaagatagagtaaattccaccttacgtatcatcatttgcaccttggcgcctattgttatcgatattggtgttttattcttctgtatgggtttgtcatgctgctctggccctttgttgggcatgtgctgcaagaaaactggttctgttatggcagggatcgctcacggtatcgctgttgttgtccatattgtctttttcattgtcatgtgggttttagagggttttagttttgttaggatgttgattggcgttgttacatgtatacaatgtcaaaggttgatttttcactgtatgactgtactgttgctgacccgtgagttcaagaatgatcacgctaatactgccttttggacaggcaaatggtacagcaccggtttaggatatatggcatggactcaaccgacaagggaattgactgcaaaagtcattgagctttccgagtttgcagcggattttgttttggggcatgtaattttgatcttccaactaccagtcatttgtattccaaagatagataagtttcactccatcatgttattttggttaaaaccatcccgtcaaatccgtcctcctatttactctttgaaacaagcacgcctacgtaaacgtatggttaggaggtattgcagcttgtactttttggtactgatcatattcgcgggatgcatcgttggccctgccgttgcttcagcacatgttccaaaagaccttggatctgggttgacgggtactttccataacttggttcaaccaaggaacgtatctaacaatgatacagggtcccagatgtctacttataagagtcattattacactcatacgccatccttaaagacctggtctacgatcaaatgatttttttagtttacaatctatttttgtttctaagcaagtttatcacgcaaatacataagtatatttttactttctattcttcctagtttatatttatttcattgtaactttcttagaagctcggtcctctcgctatatagtaggatctgcaacatatttggatgtgggtgggcgttctccttcttttttagatgtaaggtccaacacgtataacaggtgatacacatagaaagacacgtggaaataacagtcatttacgaatatttaaaacctgagcaactccgtcaaatttgatcttaatcttttctggggccccatctaattcccagaaagcccttcgaattagaaaccggatgcaattttggcttgatcaaatagtaacgcttctctccgggaacatcaacgtacatgttgataaagtcaggttgataattctgtttggattctttagcctctaagtgaaccaacgctattttctttttggattcaacgtggaatctcatatagtgatgtgtcctaccttctttatctaattttttggtagatactataggcctgtttcttgtccatttgtcattcgttataagctcaccgtacgctttcaatctttcttttcccgtaatgccatcgtcgcactgtaacaaacttcttatatctttgtttttctctaccatagaaactgctctgttgaaaagctgtgtatcacctgaaggcgaaaatagttctgaaagaattaggtaaataacaatagcagatataccaacagctcctatcacaagtatgccagaaaaggtgaacgtagaagcggattttacttgaggccataatggcttaggtttattcctagtcttgtcatccttctttcctgatgttgcgccggtgccattactatataatcttgttctaagcagtgacgtatgagttattaccgatgagttcacgaaagtattatatcgtggaaacaaaggctttctatgtcctaaacggagtaaagacctaggcaaacttgagctcattgtttaaacttggagtcaggaaaataatatacgaatgattttaccaacctgatatctaaaattaaatttagaactataacctgctgtcactggcggaaaaatacgccctcaggtttgacctagtagagctgaacatcttttcactgctttctgtatcctttatttattggagcttccgaaacttcccaagaaaagtgaagaaaaaaccaggaaaatcaaaagacatgacgcatataatgtacaccttttttttttcgcggccaaaaatttaacctactcatctagatcagtggttggtagagcagtattccgtcatttttcatgtccaggttcgaagctgacctggtattatccggttttttttcttgttgaccaataggaaaaaaaaaattaaaataaagtcacagaaattcaatgaatattataaatttttcttgtttgtttccctagttgttatttttataaaaaaaattcttgtagacaataaaataagaaatgcccattttgtaacttagcgaaagatgcccagtacatcccttttacacccgtgcattaaaggtgtttgggtttaataggagctttatcatatctctttgattttttttctgctgtcctcggcttgagggactcacagagatctggaaattttcagattgtcagtgcttaggatgggttgtcagtagacggtggccgccgtggatgggaaatctcatacgtttacacacatagtgtttggaaattaatagtagcaatagctatctggctactgttttaaagtattagcccgttctcagtgcttcttttttaaggaataacaacggcaagaccaaagatatatcaaatatggctaagcaatctctaggtatgtttggaggatacgaataacgatagaaaacatgagtgaatttccgtccacgaaaaaatgttaacataaaatgcaagagaacaattaatcgaataatgttaaattattgtaaaacaatgtgtatgatgaggaggaatgtacctaagaaccaaaaaaaaaaaaaaaaaaaacagcttttgcatattcaatccaggcatagggcgactatttagcactcaacgatttttaagcttgtgtattgctgacataaattccggctttagaatccaatattgaaaaacgtgagtacgcagaggagatagaagaaaagtaggaagttaccgtttatattgatttgtgaaatgcatactccgttggatgtggggcaacatagatttaagtgtggatgaaaattatgtgctcattgtgaaaaaaaagttttgcttttactaacaaatttttttattatttgttttcaatagacgtttcctctgacagaagaaaggccagaaaggcttatttcactgctccatcctctgaacgtcgtgttttgttatctgctccattatccaaggaattgagagctcaatatggtatcaaggctttgccaatcagaagagacgatgaagtcttggttgttcgtggttccaagaagggtcaagaaggtaagatttcatctgtttacagattgaagtttgctgttcaagttgacaaggtcaccaaggaaaaggtcaacggtgcttccgttccaattaacttgcacccatccaagcttgttatcactaagttacacttggacaaggacagaaaggctttgatccaaagaaagggtggtaaattggaataaactagctcgactttaacatagatcatacaaaaaatacaataaataaatcctgtgtttcttttatgtatattttttatcaatttcaatttagtttagtttagtttctttaaaaataaaattgtaatttctcacattctgccttcgggtctcaagggctggttggtagacgaatgcgcttgtttctagctgagcggcagatgcatgaattcaatgcaagaaaatgagaaaacttccaatattaaaatgtgattgttaattattagtatatttatgacaatatatatatgtacatagggtgattatgaagatgagtaagatgcgaatggatatgaggatatgaatctttttagagacaatgaagatgcaaagaagtagttaagcacattgacctcagggttgctatatgctacttttagtccgttggatttctgaagcagtattggccacaaaaatttcttcattatttctacgattagagtttcttctggatttttctcgtccctgagacttactccttttcaagtcattttcagcagcagctttgattaaatcatatcttgtgattttacttggagagctattgtgatgggaactttgtctgcatgtgactgtattagtcagagatgttatgggcttaaccataagggaagaaactatggcacgcatgaatgaattactgcttttactgctgtcatctgttgagtttgctgagtcttccgttcttgtagtcttggctggtgtgagtaacattacgtattgtttctgtagagaagataacttataacttccgtcttgtcactagttgttttaattatatgtttgttacaagtttttatgtatagatatatgttacaacttttagaagtattgtggacataacagagagaagggaatgttgctatatttatatattttatatattgccctcaaaactgtatctcatctttttttctgcaatccttgctttcgtaatctaagtgtgggtgacatgctaaatccgcggctttccttaagctttttcacaaaccatctattatgtccagaagctccgctgattatccgtggaaaagggtcttattctgccgtaggaaacttcttctcgagaaaaaagtgagttcacccgcggcgctctcgtaaaacccgagggccgattctttccctccgtggaacaatcggccccgcggcgtcagagggtattatctccgcaagtgatagaactcacatttattctacgttctgcatggttttgattatcttcttttgcacgatgtcacatactttttcgattaccgtcgctttacacagtaactgtttaaaacgagcgttcttaattaataactgtaggagagcaggctttcggctttctttatgagaaataaggactactccagcttgccaagttttatccagttacacaaacgctcaagatcgcctcgctaaaatagatgaaaaaataagaaaaatgaaatgttcaacctaatcccttttggatttatcattgaaagatcgctgatttattcttttccaatacgcctcgtaattctctttcaatgtcaaaggcgccagattgtaagaatctgtcatgtaaaataatctgacaatacgtagttttaaaaaccaattgattaaaccaagctctcttatgatgccaactataaaaaaataaagtgatccagtcagtgcccccacgctgaatcccacgattacttgatctaaattgtggtagtgcaagtaaactctggaaaagcaaacgcaaaacgataataaagccaatgcaccagaaaaaatgcatttttctaagaagtttagattcttccaggaagtgtatatcttcagagagttataggtaaaacaaaaccccatgaattgggagtgtgcactgggcatcccgtaaccggatcttatagtgtcattttggaacgacgcaccgaacgatacggggcgtggctgttttattatattcttgatcacgttattgaatatttcgttcatcaattggccaaaggctacaatgcaggcttctaactctcttgtgatgataaaccacgacaaataaaaagctagcactaggatgggcatcagcgagaaatatgcactaaggaatgatagaaagtcatgcgaatcatagagaatgtatgtgtcatcgaatggtataacatttggatttggatttattgcagcggcggtactattcatgatatgatccgattcaaaacaaattttgatgtagataaaatgcctggtataatgagtggtagagaagaaaattagacgaaaagaatgagaacgaagaaatgatttaaagtgatcacagtggcaatcactttcccctttttaacgcgtgttgagcaatcgattgatgtctctaccatatgtagcattttctcagaaggcaaacttttctttttctttctacttttccaacaagaaattttaagttttcccagaaacccgaattctcctatttcatccaccacgtaagaacggttttcttcctggcgtaattaaaagcataaagaaaaactgaacaagctctagatgtagatcagggtatacatggtgcgcttcagtaagtgtactgtaccactagtttggcgtctgtcacttgaattgcggatttgtgtagagcaatgaaagcgctgcttctgccgccatcaaaaaaaactgagtagttattaaagcctatgtatgacaatataaaaatgtatacagatcagtctgtatataaatcatgaaaatatctttaaaaatttcaagagcgtgtttccgctaaaccttgtcatattcaacacaaatcagtatcattctcggcgtaaattacatgcgaatctccctaattgtgattcaatattccagcgaaccccgagaatttaaatagaacagagtatatgcatttattaacagttattacgccttgtccccagggagagtagtaagggatatgggcatttataaatgtacataagtcacgtttttgcagccaataaaatataataatagaatagtaacaaggaaagctaggccaaaactccttacatggagctagtataccccttttctaagaggagtacttggcaatcagttgatcaacaagggcaatgtattccttttcggcatcttcctgggatttaccttttaagttttcccaggcttcccacttgtagcggtccttcatgttgaaaataccaggcttttccttgtcgttgtcacctacagtggcttgcttgtacagagcatacaattctaataattcatcagtggagggcttcgttggtagctcgttgacggctttagctttttcttcgaataattgggaaaccattttgctgaaaacactagtttaactaattttagagttttagtcttccttcttttgcttcacacagtgaaatgatgtacataacgtacttgcttccgagacagaccaattgatccaagctagctatatatatggcggtcattggggagttggcctggagctgttgagtttgcggacgtgtcagagagcgcgtagggccgccagcgccacctgtcttcaggcaccaaggccgtaatctcttccgacggtcattttttaatggaatgtttcaatacgagagtttgtggcatgtagtttaggaacggattatagagaatagtcgaaatatgtttagtccctacacaaattgctagactacctgtttcgagtttcctctattcctttgctaacggagctgcggtatataaaccatcgtagactcaaagccgttacccgacaactatcgggtatagtgaaatgcctatgttttcactttaagaccttagaaaactatcatgagatctcgccttcagatgcagatatttcagtggattcacgaaacaagaaaaattcactgatcgataacatcttcctttgcttgatattccctttttgaatttccctaactaccttttgttgtttaccacatattctctaaaaagcagagttattcttattttgtatttcattgcatttttatccatttagttaatgaccgaattagattatcaaggaactgctgaggcggcttctacctcgtatagtcgaaatcaaacggaccttaagccgtttccttctgcaggcagtgcatcttcatcaattaaaacgacggaacctgtgaaagatcatagaagaaggcgttcttccagcataatttcacatgtggaaccggagacttttgaagatgaaaatgaccagcaacttctaccaaatatgaatgctacttgggtagaccaacgcggcgcttggattattcatgtggtcattatcatactgctgaaactattttataatttatttcctggtgttaccacagaatggtcgtggactctgactaatatgacatatgttattgggtcctatgtcatgttccatctgattaagggtacccctttcgatttcaatggtggtgcttatgacaacttgacgatgtgggaacaaattgacgacgagactttatatactccttcaagaaaatttttgattagtgtcccgatcgccctattcttagttagtactcattatgctcactatgatttgaaattgttttcatggaattgttttttgacaacctttggtgctgttgtcccaaagttacctgttactcatagattaaggatttctatcccaggtatcacaggtcgcgcccaaattagttgaacatagtttatttcaatcttgtatctagatgtttttgctatatttatattttctgggccaaatcactaacgctttgaaatttcaaaagccaacaacggatttcggacttcatttatgtaaatgaaaaagaatgtgaacaaaaattgaaaaaattccatattaatgcaccttctaaacctatttgttgaaattgtatttaattcatataatcatattctattcaaaaagaataacagatagtattagcactatttcacgtactgcttctaatactattatcacaaaatagacatcggaaaactcaaaaataacgacaactgcaggactcgaacctgcgcgggcaaagcccaaaagatttctaatctttcgccttaaccactcggccaagttgccaatgtatacattgctgtttcctggtttgaagaagctaatcgtgcacgtaaacaacaatctatactacaagtaaaaaaatggggaaaaagatgctgaaggtgagatatatgtgggtaattagataattgttgggattccattgttgataaaggctataatattaggtatacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggagataaaaatttcaaaatgtttctatgataaatttataatgaatttataataatgttttgggctgtttccctttagattatttagcttatcgtacataatcgcacataatcagactctttattatatataattaaatatttcgagatttacatactagtggttacttaaaagtgtaatcgcaaattatatcagaaatgaacaaagatacgcagtccaaattattgacaacaaccagcatatgtacttagtaatattttatgaagttactaaatcaagattagaaacgtaaaaatagaataacatgatcaagttcaagtctgaatttcctttaatatttggataagtaaattcactacgtgacatgattggttggtgccaacataacacaattttaacattatgtaatctacaggataagtagcattctgtgtaacaaattgtagtaagtctggcaaatctctactctcttaaaggtataaggattgtccagatacccgatattactagaggccgtcatgtataaaatgtggtaacgtaaaatatacacttaacagaaagttaaaaaaggttaagttatacgtggctttctccttttttcttttcaagtacctacctgctgttaattaatagttaatattgatcacgagaataacagatcttcatatacagtataagagagatctataaaactaaaaatggatagattttgatgaaattcgtgggccgatatactcttcagtttgtcattcatgatttattataatatagacttcataagtgaactttgtagtttctggtgattactatagcgatacttttcgaatagtcacaacaagagcttctgcttcacgttttttggaaacaaaagactgaggaggggctaaatataaatactgattcatattacgaaaggaaataaaaaaataactatatgtagatttatattaatattgtataattgcagtccttgtatttgaagagaatgtggattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagatttatgggttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcacatacagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatatcattgggactaccaggtcgcttttggtttcgtgcagtgaaggtagacgagtgtctaggtgaagtagtatctgattcaatggtaccacccatttcggtactctctttattaatgatatggggtgtacgagatcgtatagtagatggaagaatattgtattcagatatgtcggcatcaacttcttttggtgcacgtactttttggactggttccttgtctaattgtaaagggtttattgattgggacgagaagtcgttcactagaggatcagagtttatttcaatctccgattgatagtcatgatcagattctgtattttgatcatatgactgctccgtttcattttgttcaataaaagattggttatgggctgttaaacgattgagatcatcatcaaaagtgagtgtatcgtagtcgaactggtccaatttcgtttgcttgttttgtaatataacgtaattggtagtatctactgtcttttttaatgatggaagatagataatatagccataagagtttcgtgacggatgtaaggcgtaacctggaatgccacgaggatgtattttcgagtcgggattatggttgttaactataaccggttgaccgaaaggtagtatagtagtaatgtccagtccagctaaacctgcatgttgtcttgcagatttatcgttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtatgcaagtactgaaaaggctcatatgattcttggtactttagtcgtgatcctttgacatgcctatgtttcgtgcttttgccgattagacagtcaggacattgatatgtgctagcgttagaccattcaatatccgattctttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttgattagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctattgtgcgtgttggcttagattctttctgttgctggcctaagactaagttcgttgtcatcgcttaagtattgtgatgaaacggttgattcattaatgtgatcattgttcacccttgagaatttactagatgtagcaatattgtgagcttttgctgctcttggttttgaactatttgttctatgataattacgagttgtaaccttcgtgttagtcgtgtttggagatgtgcgagaaacatttttgtattcgctgtgttgtttgtattgggacggtttatttagattcatgattttattttcgtcatatattaattgaatttcagcgaataattgggaaagtttcatgttcgttttggtacgatattgattacgtaggtatttgaagtcaccggatagacctttaagtattagttgacaggccaatctgtcgctaacattgatattgttttcttttagcctctgaatgatcgtactgactgtaatttcaaatgtatcagcagatgtacttccgtcgtactcaaggttggcaagagctatccaatcctttaattcttgattgttagtttgcattttggacacacttttacaaaggactgtaaggatgtcagcataattaatttctaaaatttgttttacccatgttggcaataaatgaaatggggcaaatgcttggaaggtattgtatatatacgcatgttcttcataagtcatttgtcttttgatttcaccctggtcatttggaatgatgtcaccgagattagagttcttcaaaaatctgatgtaaaatttaacccatgtagaaaagttttcttctgatgttaaagtgtgtggtggtaagacgttatttctcacctttgtcttagcttgaggtacttcagagtgttgatcctgtgaatcgattggatcaggtgaggaagtactcagcggtgggatatactgtggcagcggatagtgtgggtccggttgataatacgcaggtgacgtttgataatgtgaacacgtcatcatagatggttgttggtaatgtgcccagttagaggccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagtatttatgttttgtcattcttttctacataatcttgaaactaggtagatctacaattgaaaagtaaatactaacattatttactaaatttaagttagaaatcggcacgaaaaaaatttgacagattacgagagtccagccaaaatatgagtatattactatttccccttggtgaaagaaatgaaagatgttattttttaccggcttagtaatactgagctacttacttgggggaaagaaagattggctacttattatgtatgaagcctcagattaccttgaattcctcaaccgtttgagcagtatgctcttcaaattcgaactttttgaacatctttcctccacattcctgattttttcacattcaaaacgcgctgtgaagctgttagaaatttacagatcgaggcatatttctatatataatgtatttttattaagacacccaaagtacttccaatctgtagatattgcactttatctgaccagaagccagacttgaacagttacatattgtgctttgcagtcgttaaatttcccgaactgttttcgtatttttttttcttttcctcttttccactggatcagatcaaaagccgactaaaaatttggcaatttaaagaaagcatcttttaaagatagaaaaggttatttcaacaaaaaagtatcttttcttcacttttctttcaacaattcaaagatggctagaaccataacttttgatatcccttcccaatataaactcgtagatttaataggtgagggagcgtacggaacagtatgttcagcaattcataagccttccggcataaaggtagctatcaagaaaatacaaccgtttagcaaaaaattgtttgttacaagaactatacgtgagatcaagcttttacggtatttccatgaacacgaaaacataataagtatattggataaagtaaggccagtatccatagacaaactaaacgctgtttatttagtcgaagagttgatggaaaccgatttacaaaaagtaattaataatcagaatagcgggttttccactttaagtgatgaccatgttcaatactttacataccaaatcctcagagccttaaagtctattcacagtgcacaagttatccatagagacataaagccatcaaacctgttactaaattccaattgtgatctcaaagtctgcgattttggactagcgaggtgtttagctagcagtagcgattcaagagaaacattggtaggattcatgacggagtacgtcgcaacgcgatggtacagggcacccgagataatgctaacttttcaagagtacacaactgcgatggatatatggtcatgcggatgcattttggctgaaatggtctccgggaagcctttgttcccaggcagagactatcatcatcaattatggctaattctagaagtcttgggaactccatctttcgaagactttaatcagatcaaatccaagagggctaaagagtatatagcaaacttacctatgaggccacccttgccatgggagaccgtctggtcaaagaccgatctgaatccagatatgatagatttactagacaaaatgcttcaattcaatcctgacaaaagaataagcgcagcagaagctttaagacacccttacctggcaatgtaccatgacccaagtgatgagccggaatatcctccacttaatttggatgatgaattttggaaactggataacaagataatgcgtccggaagaggaggaagaagtgcccatagaaatgctcaaagacatgctttacgatgaactaatgaagaccatggaatagtattcacaagaacatttctgccatacttctaaaatttccctatattcagcttagcagtgacacgttgtggtctgtaggtcaatatgtaagtaagaaacttcaactcacatatgcacgatgcatgccaatggaaaaatgcaaggaacgaaatggcgccacggcaacaagttttttttttcgccagcagaagtacacgaaatgcggcttcatgagcctcttcactgctttgcctaaacgggaaatgcagagaaaaaccagccatcgcgtgtgcttggagagctgacgcgactgtaatcaaagaggcgatatcaacaccttttatccagcactattcaacagtgaatgggctcccaagtaagtcttggcattgtgctttctattcttaagtattaagtagaagttttgtttactgggtttgtttattcctggctagatgttcgcattcgttttctagttgaccatatttaccaaatattcacaactaatacccagccaaggtagtctaaaagctaatttctctaaaagggagaaagttggtgattttttatctcgcattattatatatgcaagaatagttaaggtatagttataaagttttatcttaattgccacatacgtacattgacacgtagaaggactccattatttttttcattctagcatactattattccttgtaacgtcccagagtattccatttaattgtcctccatttcttaacggtgacgaaggatcaccatacaacaactactaaagattatagtacactctcaccttgcaactatttatctgacatttgccttacttttatctccagcttcccctcgattttatttttcaatttgatttctaaagctttttgcttaggcataccaaaccatccactcatttaacaccttattttttttttcgaagacagcatccaactttatacgttcactacctttttttttacaacaatttcattcttcatcctatgaaatgacgaaaataaccagagatgtttcgataacgacagaaaattcaaaatccacatctggatcggcaacggcttcatccgcatctttacctgagaacgaccacccaatattccatcaaccgcgagcaagaataagatctggttcgctgttcatcgaaggatctgattcatttccatcatcagaagtgaagtcatacaatgtttatattgatgatagcaagtatagtgaaatcctcaaaggagatacaaattcaagtagtactgatggtaaacaagtctttgaagatgctagagatgacaatttccatcaggaatcacatagagatctagaggattcaattttagatttagtacgacgagatccagaagtagcagcattccctttacctccgccaaattcaaatgagaggaacagaaattcctcaaacgggtcttccgctgaaactaacctaaatggacacagcagcagcggtaccatctctacttcggtgctgttgaatatgggttcggcagaaaagcacgctgggacgaccagaggagatcatatggaatcatcttcaatgaaatccttcgagaaactgggaaccagaccttcttctttattctatccaccacccgaaggaactgcgccgtaccagggaccaagggctaccgtctccggaaataagtctacaaggcaaacacaaggtacatactcatttccttctatgcggtatggtgtagatcttgtttctcctgtggaaggggctgttgatgtagcaaaaagcagagttcctaacagcacgctaaatggtacttttcccgataaagcgtttatcccacatgaatttcaaattcctaaaaaggcctggaacagaataccagcgaataagtccactagcctcaaaaccccaagaaaccattccctattaattgacatattaaagccttttgaagcagctgaccttgctaatgaccagcgaagttcttccgctgttttaaaaaatacagtgcattctaatgggcagtataatccaactaatgaaacctctggaactcgaatgcaagatcaaaggcagaagaataccaacgaaattgatttagagaaaattcctaatcctcaagtccctcttggtatcgcaatggacaccatgcgtagtccaaaccaactacacgaaaaggaatacgaaagtaatatagaagctggtttagcttctggggtcggaaaaggtgacaatagtattaagcaacatcaatataaaaaaattcctcaagaaattgatcgagatcagcaattaagttttcaaatggaaacaatgcccattcaaagaatagattcctcctccatacgttcatttgattcccgaatatatggcttctccgagatttatagtattccaagggttataactacactgtgcatctgcctttttgttccgcccttattctttttcttttcaatcaatggaaataatggcgtttcaaattatagattaatgagaatgataatgaattatgaacatagaatcggcctcctcaaagggtttgaatgggacattgacgtacaatggttcaggacattgtgctttgtattaggatgtatagagatgttagctatctttgctagcataggaataggatttggtgtgggaataataagagagtaactccatgctggacttactcgtcgaagatttcctgctactctctatataattagacacccatgttatagatttcagaaaacaatgtaataatatatggtagcctcctgaaactaccaagggaaaaatctcaacaccaagagctcatattcgttggaatagcgataatatctctttacctcaatcttatatgcatgttatttgctcttataattggtctctatttagggaaaaaagtcggtttgagagcttctcgcgatgtgaaatctcaatttgaactgcacgccaaagctagcccatttcacgaacaccagaaagaagaaatccccaaggatcgcatgacagagtatgctctctcatatcgttgagtatgaatgccaatacactgatcagctttacaagaaacgtaaaatctggcacgatggtagactgaaatactttcagttaaacaacagattcatgctttatacggaaaaggataacgttttgttagctagtgaatttaaaataaattcaaaagagctgaaagcaattctaaatccagaaggttttgatattgaagaacataggatttttagtcagtttttggtgattatttcaaatattattgaggagtacgatagagatattcaagtggcagcaacgcatgttagggcatatccttcaaatttgtcggtgcaaaaacaacgccctcttatctcagacaatgcaccaagtttgaatcatatctcaactgcgagagaagttcattcgaacataaaagtcacaactcccaatcgcaagcagacagaggacaatgccaccaagggaggattcaacatcagcaaacttactctgaaggtcaataagcctttcaagaagcccaagaggatattaagtactaatgtggtaaatgaatcaaatagaccgagcataaggagccaaaagattcaggaagtgacaccacaactacacgaaacaaacacaagcactaaagtgcagacagccggaaaagttgcgttgaataatgataatattgcgcaaggtaattacgccacgattaccgaagaagctaaagtcagagacggttccgacagaaagaaagatatggcgaacctatccaaaagtggtaaaaggagagtgggcgggatacgaagaattgttcacgaacccctcggaatttgattatacgtcagaattttaatgaatatataagtctgtacactatgctatgcacatatactcaaacaaattcaatactaagtaccgaaaaggaaagtggtatatatatatttatatatataagtaggtacctctactcttaatgatcacattttttcttcaaccagtttgtacagtgcttcaatgtctgcggagaattttctgataccatctgatagtttttctgtagccatttgatcttcgtttaaaacatatctgaaatgaggctcgtcgttgataaaagagactttttcgacgccttcttccttagcactctcagaattcaatttgttttcaataggatctgttgattcatataactgttctagaaggttcagtgggagagtcatattatcaataccggctaacgccttcaattcatctaaattcctgaaagaagccgccattacctcagttgcataaccatgcctcttatagtaactgtatatcttcttaacagaaagaacaccgggatcagtttctgcagtatagtctttgcctgaaagggccttgtaaaagtccataatccttccaacaaatggggagatcaatgtgacatttgcctccgcacaggctactgcttgcgtaaaggaaaacagtaatgtcatattacaatgaataccatgctttacttccaattctctagcagcttggataccctcccacgtagaagctatcttgatcaagactctttctttaggtactcccgcatctttatatagtttgatgatgtggagagccttcttcaccgtcgccttcttatcaaaagataaccttgcgtctacttcagtggaaacccttcctgggactaccttcaaaatctgggtgccgaattccaccaaaatcttatccatggcgttctcgattttctcatgatcagttttgccatgctttctaccatattcaacggcagcgtcgataaacctcgcatatttctccaactttgaagcagccaatatcagagaagggttagttgttgaatcctgtggttcatacttcgaaatagcctcaaaatcacccgaatcagcaaccacatgggtcccggccttttttaattgttctaaagatgaggtagcaactttttgttttttctctgaaggttctgacatatttaatttcttgtatatatgtgattatttcctattttttatgacttacgctagcaagaaataatgatatacttagcataaatatgactgcgctgcaagattgctcttcttttatatgttgtccaccccattctagatggttagaaggatccactatgctcccctcattcgcccctactatggaagaagaagagaaggacaaaagacgtatttcgttacaagtcaagaagtccgaggagtacaagagccaaaatcagagccagagccagagccagatcaaggaaagtaacctataattccccgcgttaacagtccagtccctcttattgaaagcttcgtcatcctgaaaatccttcaacccagaccgactgttgaaaagcccttttgtgtcacaaatccgtaaccatattaccctactaacatccggaaataattgccgctcactttagggaaggtctctaaagggtaataatcgagttgatgaaaaagccgctacccctatttgaaaaataatgaataatggctttctggcatgaatagatttaatacaatgctgaccttgaaaatgtgaaaaaagaaaaaaattaatataaaaaagaaaaaaagtagaaaaagaaagctatcttttttggtctattcaaccagatagtgtgcatttattatattgtccccccatattattcatcaagaaaattacaaaagagtaatgccatttttcttcttttttttcttcttcttggctgtacagatctttttccataaaatgattgatctagcgattattgtttcttaatatttttcctgtcctgcaattgttctcgaggattgctatatttctcaaagatattttcaggaaatgtgcgtgcgatgtgagtttttcattgagggtatttagaaaaataaccgccaacggtgagaacataaaaatcttagctggaaaagaactgccaaagatactattacctagagggttcgtaaatacggtttgtggaaccagggcgatgcaactaaaaaacatataaattggaaattacgagactttcggcacaagaagcgctaatatcctacttaagtggttgaattcttgtatgattaaaaaaaaaaaaaacacctgtcttattttcaattttatggtactgactttgagggtacgtgaatcatcgaaggaaacataattgcactgatatgtaaacttcctagtttcaaatgttttctcggaataccaaataacctctagccataagtttattttcaaactttttcctcttaggtgataagggagattagaaaaaaagaaatatttattattgaaataactgtccaaagaagcaaagtgaatatagaagaaaaaatgcgagtacttacgattttttatttagctaagtaaccaacgtggtgccatattcacgacatagcaagtgtccatagttgcatgcgttttctttaatatcattgtgttttatttttattactttaagaaaaaatacagtagctttcatgcctgcacaaatttaacaagagtttcatggggtacatttttaatgcctcaactatttggtattgttcaaaattttcttcaaacgcttgttaaatcttgaatcagcgttgttatgcaccatggccacatgtctcttataggcgtctttgcgcctaaacgttttcnnnnnnnnnnnnnnnnnnnnccaatattttccagggacattgctctatgggacacttacacggtctttcaaggttgaattcgtctaagtgcgcggcaaactcaactaacgttgcgaacttttcagaacaatgagaacagtggtaacttcctctttttgtttgcccttcggaaattgtgctgagtactttggggtcgtgatatagctgtgccacgtgcgatttttggggatagcctagaatacactgtgaatgggattgttctgttgtattgctctcaataaatacaggatttgctcctttttgacgtccataattaataagatctctgaactccggatcaactaatgacgtgatacagtgtgtactgtccgctatttcatccggccgtaattgaggtgctgtaccttcctcagtagacgacgtagagtcataagcctgtctctgatttccggctataactgtgattgtgttttctaatgatagtagtaaacagtcctcagtgctggaaggcaggctggaaggcaggctggaatccccctctaagggtgatgccgaatattctttcatgttttgcccgaaatcgtgccaatgataaatcggttgcacctcttgtaaaacctctctgttccaagaccccttggcgatggcactgttttgtccataacacggtgacataagtgctgaaaatcccaacttctagtaaagaattaacaaattcaactgtatgacttataggataagaacaatgtcagttccaatgcgttgacacagtagaaaatatatttactaagaagcagcttcgtcgttggtatagtttcggttgatctagatataaatataactacaaataaatggcaggaaaaattgaagcaaatgacacaggacatatctatcacattgctccctttaatttcctcgaaggcactctggcctttgttctctgcataagaaaaagccagcagaaaatacggtgatatatttaatacatgcccggccacttttctgctggtaaagcccaccggaaaagttcggattttcttatccagtatacgccgaccttttgatgtaatctgtgacatctcactccggcggccattttacgtgacgaagcatcccttacaacagaaagaagaaaaaagatatgccgctttgcggtttctttctggcaatgtatgcactcataatgctactcgtttacccactatccctgtccaaactaaagagggaggaaagcactttttgcatttacacatcgtagattataaaatgatcgttaacaggcgcttgtgattttgaatttaagaaatgtggactagagaagtcttaaatcgccaatgctgtaccagactctctatagcatctaaacacgaaattcaactgttatcttagtttttcacttaccagtagcgcgcttgttattcccacgttattatttgcccccacatcataggtcaagtgaccttctcttacccgacatgaataaagaaaagaaaagaaatcatacccttcagcctgtttagccataaatagtaaagagtagatgtttcgacggactaaataatgtgaaaaaggttctaaaaccttcaaaacaattaaacttgagaaacgttgctataggattgagctaataatttgaattaataggagctgctttttactttgatatatcctgaagttatgttacgagtttctgaaaatggtctacggtttctgctgaaatgccattcaacgaacgtaagcatgtttaataggcttctgagtactcaaataaaggaggggagaagttccatagatgatgctggcattatccccgatggaactattaacgaaaggccgaatcactacatcgagggaattactaaaggcagtgatctggacctcttggaaaaaggtataagaaaaactgacgaaatgacttccaattttacaaattatatgtacaagtttcacagattgccccccaactatggaagtaaccagctcattactatcgataaggaacttcaaaaggaactggatggggtaatgtcatccttcaaagctccgtgccggtttgtatttggttacggctcaggagttttcgaacaagcgggatattccaaaagtcatagcaaacctcaaatcgatataatcttgggcgtcacatatccatcacattttcactctattaatatgaggcagaatccgcaacattattcaagtttgaaatacttcggttccgagttcgtgtctaaatttcaacagatcggcgcaggcgtatattttaatccatttgcaaatataaatggacacgacgtaaaatatggggtggtttctatggaaacacttttaaaggacatagctacttggaatacattctatttagcaggacgactacaaaagcctgtaaaaatattgaagaatgatttgagagtgcaatattggaaccaattaaacttaaaagctgcagctactttggccaaacattacaccttagagaaaaataacaataagtttgacgaattccaattttacaaggagatcactgccttaagttatgcaggtgatattagatacaaactgggtggagaaaatcccgacaaagttaacaacattgttaccaaaaactttgaaagatttcaagagtattacaagccgatttacaaagaagtggtcctaaatgattcattttatcttccaaaagggttcacattaaagaatactcagagacttttgctcagccgtattagtaaatcaagtgcattacaaactattaaaggtgttttcacagctggaatcacaaagtcaattaagtatgcttgggccaaaaaactaaaatcgatgaggagaagctagtgtatccaatgttatctacacattatcttttatcaaaaatgttttatcgtcctttcatctctttcgaagaatcgctctattcacattccaaatctctggcgtcggtcaatatttattcatctttatttttaccttcttctagataatatacattatcccatattggcattcaaactgacttacttgcattatggaagggggatcatacgttccagtatatgcaatggatgtcgtacttacgaacacattgtagcatttgaaggggtatttctatatatttctattattaagggttatattacaattatactttatagtttaaaatatttaaacaagttctcaaatacttaaatacttctccatgaggtggtcggccaactcaacatttccgctttgctgatatattataatactgttataggcagcatgttttttcaactttccatcatcgtagttttctagaactctattatagtactcaattgcaatcgataccagaccgattaaatggaaagcacgccctaagttgtagtctgcctcttgcttttccaaatccgtatataggcttttccttattttatgataacgatatagataacgtaatccatgaaaaatttgaaaatgcctttgtgctgttagtctctgcatagcacgatgaatatgtgacagacccattaaaagattgaccatcgggtcatctgggatatcctcttccaacctagttaaatactgtagggctgaaagaaagcccctactggaatagagaagaacagcatagatatagtacaaatatggcgacgactttttattagggttgtacacctctttgttcgtaattgaagcttgcccatttacctcggtattatatctacaactgtcaaaagctttcagttgtcttaagaaaaatttttgttgaatggtagagctcaaaatattcagagaagagggtcctcgacatagggaatacataaatacctgcaaaacttttctattaaattgaaattgatttagtaaacctcttaaattttcggccaattcctcttcatcatccatttgaagaacaatagctagtttcacaaatttcatcatcttaaccctctctggatcctggaagaacacgtttacttcctgggctgtttccacaacactcaggccgtcttcaacactttgatattttgcgattactaaagaaagttccataaataactcaaaccactgctcatacgacaatcctctcaattctgtggcagaagttaaggttactctttcctccattagcggcccttcaaacacactatctccttcagctaacttagataacctttcaatttggaaatcaagctcggtgttaaactttttagttctccttagtattccaacgaatttcctggatcgacttttcataaaaaagttcttaacgctcgaaaatatatcaactaattcagaaactgtattgatccatatagatgcctgtttggcttcattgagacctgaatttagttcaaattttttcatcttttcgtatttatcaacgacttttgccgttattcttctttccctttctattctctctctttctgcatcataaggtgtacgtttctttttcctgaaagttctaaatttactatcctccagcagcggtttactagaaatatccgaagtatcgttagaacttttctcgttagaaatcctgtgcagtgtttcatcaacctggtgtttcctcatttctacaacgtcaactaacatatgtttaaaagtctctggatcatttaagcgatagtaaacttctgccaaagatacacgaatatctaaatcatctggttcagattttatagctagttcataaaactctttagccgtttcataactttcgatttccttgtagcatcttgctagtggtttgaagacgtcagtggtacgccattcctcaagggataacaacggcgtaaagaaatcgatagcctctttatacttttcagcccttgttaaagcagttgcagcctcaaaatataaatccgcaacgtcactgaaagtctcatcatacaggcattgaaaatgattcagagcttcaacaaggttatctgtgttcaatcttaacaatcccaatctaactctaatatcgattggaatgttatacgatttttccttttctgcggcaagtagtgaatcaaaggtactgtttttaaaccttctattgtcaaattctgaatcatctggaacatgatcccaaaatgtctggctttcgcggcgttgaatccaccgtgcacattttttaattgtctttataccatcgacctcactaactgcgagttttaagaaaagttccgcgagaatgttcaaagaagaccagtcaaatggtatgcatttatattttgcatcaatttttttccagttgatgtcaggaaacatctgcctatcttcatcttgttcaaggggttccttttcgtctgcatcctccccttctgcggcgctttcttcgtctgaagaatctaaggcattttctaaagcagctaatatcgcttcccttctctcaacattagcattaaacactttcatatagagctcaattgaatcttcaatccgatcataatcaacataaagaatggccaactccctcaatatgtttgcatcataaggattgtacatgtaaagcctttgaaatccatctaaagctcttgctaactgtcctgtcttcttgtacaacatagaccggcgataaattgattcccattccataggattcaaacttattaccctggaaaagcagtagatggcctgcctaacatgatctaaatcggcggacagtatagcgactatcttccagaattcccaatcggaagcatttaggtgagctgccaggaaccaagagttacaacaatcattaagccttccttgcaattgatatatatctcctagggtctcgtaagcagcaaaattacgtgcatcttttttaattacctcattaaataatctttcggccacttgtaaatcattcctgacaaaagcttcattggcttgagaaagtaattgcgctacctctggatcaagcactctttcttttctttggcggccgtaagatttacctttgtcatttttcttcttcttttttaccttaaagttacttgcttccctaatcgcgttcatgaaatcttcctcatcgtcttcagatatttcaccgtagtccgagaattctgccaacaaagaactgtctcgttcggaattatattcatcttcgcttaattgtagatcatgaggtacatcctcgtcatcatattcctcatcttgaatcaaatgcttatagtcatcaatatttccgtatagatgctcttcatcctcatcgttaactttacccgtatcagcgctttctcgttcagctgattgattttgctgttcctttttcaattttcctgctgccatcacagatacacttgagggtttctttctctagcttcagattcattgttgactggtgttattatacacagtgcgctgccattattatcgttcttctatttctagccgaagcgccttaaaaaaaaaaagtgtccactttgggaaactcgcctttacgacgaaaaagtcaaacttgcgttctacgaaagagaagaattccttttttgggttaggtggcgaaaaataaaggtagttaaaagtaatcctggctggtctatgtgaatagggaagagataatgatgtagttttcaatagatagtaacacataccatagcaagggaggaaaaaatatcaaagtgatactgtaaaatataataaaaatgttttctggctttagttcttttggcggcggaaatggttttgtaaatatgcctcaaacgtttgaggagttctttagatgctaccctatagctatgatgaatgatagaatacggaaggatgacgcaaacttcggcgggaaaatattcctgccaccaagtgctctaagcaaactatccatgttgaacataagataccccatgctttttaaactaactgccaatgaaactggacgtgtgacacatggaggtgttttagaatttattgctgaagagggcagagtttacttaccacaatggatgatggaaactttgggtatacagccaggatctctactgcaaatttcatctactgatgtacctctgggccagtttgtgaagttagaacctcagtctgtagatttcttggatatttccgaccccaaagcagttttggaaaacgtactgaggaatttctcgactttgaccgtggacgatgttattgagattagttacaatggtaaaactttcaaaattaagatcttagaagtcaaaccagaatcatcatcgaagagtatatgtgtcattgaaacagatttagtaacagattttgctccacctgtaggatatgtggaaccggattacaaagcgctgaaagctcagcaagataaagaaaaaaagaattcttttggtaagggccaagttttggatccctcggtgcttggccagggatcgatgtccacaagaatcgactatgcgggtatcgctaacagtagcagaaacaaactatctaaatttgtaggtcagggacaaaacatatctggtaaagctccgaaagcggagcccaagcaagatataaaagatatgaagataacgtttgatggcgagcccgccaagctagatctgcctgaaggccaattattctttggtttcccaatggtcctaccgaaagaagacgaagaaagtgccgctggtagcaaatccagtgaacaaaatttccaaggccaagggatctcactaaggaagagcaataagagaaaaacgaaaagtgaccatgattcgtccaagtccaaggctcccaaaagcccggaagtaatcgaaattgactaaaagatatatactagtatacaacaatatagtgtctttgacagatatatagagcattttcaagttaacagatcttagaatccaagtatcttatgcatcgcattagctctgctgcatttgctgttcgtttagtaaaaataattacgtgcgcggttgcgcgatatttcccttgcttaatgccgaagtaattctcttcgtttacccatactcgaatctattgtgttgttgaaaaataaaaaaaaagaaccaggttatataattgtgagttgatcagtatataaatgagagaaaagaagtttctattgttccaaattatatccaagctgattttttaacccttacctcacgaaaagcaagtttaagacaaacactcataagaatccttacatatactaaaaaacaaatgcaagtctccccagctattgtaaaaggtatcgcagtctcatcattaggtttatacgccggtattttaacttcatctaccgtgatttctattaccaccccaataaatgttctaactcaacatttgaagaatgttttgtgcacattaggatgctggagcaccgttttaggtggtttagctactggtgcctttggactcagctactatctagctgcaccaggagaaagaccaaactaccttttgtgcggacttggtgtcgccccattatctgcagcctacctatacttagtatcactgttcaatcacaagctagccccaaaatgcacacgtgaccaaaatgatttagaaaagcaaaaggatgaaaaattaccccaacatcacccggaagtcaaagatggggaagctgcatgcccattctcaaagatgaacaacgccaaaacattaaaacctgaatccgaaagaagcgtaaaatgtcactcatacatgtcattgcacatgagcattgtaaccggtataacaatttttacctttggtaagtgtatcctagatggattcaaagcatgaacgacgaagcacgtgacacgttcccttcaaacatcacaattatttaagcgagactaatatatatgtttagcgaaaaaaaaggccaaaaaaactagtaaatatacaaagcagagtatttttggctcttgtccacattggataagagaatatttatttttcacacagaaaaaaaagttatatacgtatctctaagaaagtcaaagacaaattacgtagaatgtgattcattcccatttcgcccgtacactctctgtctctgtctctgtcccaaacttcccttcctatacgtattcataatctgcttaaacgtcaacagtagtttcggaacatcttcatacgtagggaatacgacttttttcttttcacctgcagcttgagccaaactaaaactgggatccggataaactattaataaaggatcgcaaagtccatacgccagtttaatgggaatgaaatgatattgcgaagtgacgtcaagaatcgactttaagctatatccgaagtcaagaaagccgaaccttacatgcggtcggaaagcaaacgaggagattagattggttttcatatccgctaaattttcttttgattttactttggcttaatctaatgcatgtatatcggaagaagcaaccgatctggcccagttgagtcgtgctaccttagtcatgcccaggaaaaccggattccttcttttcattatgacatccgtttaggtcaataggcttttttttctctcgcccgtgcctctccgtgttcgatgaatgtgcagcttgcctccgagcgggcgagccacctcgagcgggtgacgaaatagtggaaaagaaacggggaagcaaaactgtgctgttctggcccgcagcggacgaacgtcattaaaggcgctccatttctgtcgtgagggtctttcggtgcggtggtgaggctgcgtaaacaagcttgctcttcatacccctcccgtggagctagttcggaaggactattggcgcatcttctgttgagaggttccgtaattctccgtaacgtcccgttcaccactttgcatgtgctctcacgtacggccgtctcttttcggccttcggcccgttccgatttttgtaccccttacgtgctttgaattctagaaggcatctcctctccgatggcttggtacagggagcactagggaaattgcacatggaagtatctggaatacaaagtttttgaaaagaaaagccgagcgtaatattgggacaatacccagttctcagccttttcagcgcgggtatgagacagcttgcaacaggtaaaaggaagttagaagggttaggtgaagggaacgatgatgctgcctgagaacaaaaatgcagcttcatgttacatacaataaaggaaggataattaaggggaccatgcaataagggacaacttaattttggaaaaatcggagcttagttgcatctacctactaatactttccccaaagaataataatacgagtacaatacatatatatatatatatataatatacacatgtaagtgatgactattcttaatacaaaaaaatttcccttttataataactattcttagcattaaataacccgttactgacaaaaagcatataacataggactcaagatcgactctcataccctccgaatcaaattctcactcgtatacgcaatcatttaaataagcacatcattatcagcatataccgaataataaaaagcaaaaatgtatacaaaactaagatctatacaatcaggaacatttagcacagtttataaagcatggagtactacacataaccgctacgtcgctttaaagattactcctaaatacaaaacttcagaagccaacatgaagaacgagtatgatgtaatgaagattttgagttcttgtaatcctcaccccaacatctgttcgatgctcgacttttacacggatgactcgtactacatcatggtgctagaatactgcgaatgtggtgatctttatgactttctagatattgctaagagtcaaggtagcccgtcgtctccatctttgattcaaattgatatgcaaaagataatcaaacaactgtgctcagcaatcagctttgctcacagcttgggtattgctcatcgtgatatcaaaccagaaaatattttgctaacgataaatggtgacatcaagttggcagactggggtcacgctatccaatcccctaaatctaacgacttccagattggtaccgataattacagggcgccagaaactttctctggccgcgttagtaactcttgttttaagaagaatttcgatcggtcatcggctccattgtataacacataccaagctgactattggtcattgggtgccaccatattttatctgatgttcggcgattgcctttttagagtctccaaatcaaagaaggttcagcatctaaaaaatttcgatgagtttgaaaaagatccatttgcattcatttacaggaaatacgtagtaccaaggctctcctgtggttacaatgatgaagaagacctacacgttagcctgcagcatacgaggcagtacatatggcaagatctacccgacatttatgatgtcttccatttgtgcaagattatggttgataccttattaaaggtatcgaacgctaaagagaggtcgatggagaatttcatcaatgaagttgattctgcatggaacaaagatagctcgatggacagctgcttctcgtaccaaaataagattgatctgttttgggaacagtggtctgtgaacacggaaacagtaccagcaaagttccaattgaaaaattttgagaaaccttgcctaattcaagatggaaaataagaagtaaaaaagaccttttgaaagtttcgcctcattttccttgatctgactttttatcccctgcttatccaattttagttaggaactttggcataatttcagtattacatactacctaatcgacataaaataatattacatattcatttttttaaaaaataatcataatcaatttatcctttttattccttttttctcctgtgcaaggttgatggtgatgtttatgatggtgtgtttattatttacaaataaagatgctatctaattcttgtatatcgtattaacatgcaaatgcaccgcgagtggcaattttcttctcgtaatggatcagttcaacatcttcaatggtatgaaccagaattttcgaattttcttcgttaaattcgaatatgaatgttcccttaatcagccgggataatctcttttttttacttcttttaccgtcgccatcatttttcttcttctcatcttctttggaattttgagtttcgttgaccttattttccattgacctttcagctgcattttcaaggtactcagagataacactttggttcaaattattggctgtaggatgtaaaatgtagtctatgactggtaccgacctcattgaaaatgaaccgcctgcaccattgcctcgtttctcctctttcaatctgtcattaatttctaatttggtaatcttgcaatggtcttccggtatgcagctttgccatttgatcaccaatttgtcattacatgttatggtattataactctgaagagcagatttaacttcttcatcatgcgatgtcgatgttagagtctttactgaacttatatgcaagcgacattcatcgcccaagataaactttcgtactatcattcgcattgcattcaaagaagccatgtattttgattttccatgtaacactggaatatatggatgcgatgttggaaatagtctaaaaacaacgttatccgccaacactgactccttgaacattttttgtaacaaattgggaacacctttaaccactaaataatctgttatttgccccaaattggccactttttgagaattggagtaccatcgaggaaagattcctttgatagatattatgccggctctgcaaacacactttagtaacataagtctttccccctattatctatgaatataaactgtctatctttccttggttgtgatgtatcgttttccgtagaggcttgcagctttatggctcatacctgtcatccctctttatgggccttttaagggcgctctctacattgtattctattcatttttttcgtaaccgtaactacgcgccttcttaacgcaaggcgctcgactcatcatgagatgcgtatgaatgtctttcagtgtatagaaatacatctcaccaaatctatttatttaactaatatttcttttaatattttcctcaagaaactcaggcagttaatgttgtgtcctattttttttagttctttcccatttttatagcactcgtacaaaagaaatcgaaatatttcaatatgtttagactcggttctatgtgttaaaactgcaagatgaaaaagtaacatctatcttagattaaggtcctttctttatattctttactttattagtgagcagaaatattattaaaaattgccgctgtcatactgtacgatattattacccgaccgcagaatgttcctcaatactttctttttcttcctttttttcacttcgctttcttcatgtccatcaatgaaatttcagcttcatagcgatttattttcagtgtacgttattcaatgaagattccttttcctcgatctatccagacgactagacatagcgagaattctttacggtagaagcaacctatagattaccgaatcataactttctttagtgttgattgagacgtgttgtgtttaaactatccattgcatctcgataaaaaaacatagtactacaacaaacagtcaggttcaataacacctaaacattatgtcatctcagtttttcctgaaaacctctcaggatatagagctcttccaaagctacccaacttttgagcaatccaacacaaactccaaggatttccctgtcatttcctcggttttatcgccatgtggcagatttttggctttatctacgaaggagaacgtcaaagtttttacaggtccatgtttggataacgttctattaacaatgaagttgtccgacgtctatgacctacacttctctccagcaggtaactacttaagcacttgggagagagcgtctatacaagacccaaatcacaagaacgttaaagtttggtatttgaataaaccatttaagaaagattgcgtttcggaggatatagtccctgcttacgaatatcaagccaaatcccaaagcggttggtttttacaattctccaaattagacaattatgggctaagactttttaaacacgacttgaagattgttaaattaagctccgctaatgccgacaatttcgacttccaatctccgtttgctgtcttgtctgatgatgaaacgtcccaacatttcaccacctacctaatctctccagctgaacatccaacaatttgtactttcacaccagaaaagggtggtaaaccggctcaattaatcatatgggccctctctgaaggtaaaatcaccaagaaaattgcctccaaaactttctttaaagctgattcctgccaattgaaatggaatccattaggtaatgctattttatgtttagctattactgattttgattcctcaaacaaatcatattatggtgaaaacacactatacttactgtctttccaaggtgtcaacgggactttgggtggtaactctgtacgtgtttctttaaccactggacctgtccacgatttcacttggtcgccaacttcaaggcaattcggtgtcatcgctggttacatgccagcaaccatttccttttttgacttaagaggtaatgttgtccattcattacctcaacaagccaaaaataccatgcttttctctccctctggtcattacattcttatcgccgggtttggtaatttacagggctccgtggaaatcctagatcgtctcgacaaattcaagtgtgtgagtaaatttgacgctaccaacacttctgtctgcaaatggtcaccgggtggagaatttatcatgacagctaccacttcaccaagattgagagtggataacggcgttaaaatatggcatgtatcaggctctttagtatttgttaaagagttcaaggagcttttgaaggtagactggaggtcaccatgtaattacaaaactttggaaaacaaagacgaagcatttttcgagaaccatatcattaataactgggaaccgctacctgattcgaccacatcttcacttgatcctaaaatatccaataaatcagaattgcaaatacattctagcgttcaagagtacataagtcaacacccaagcagagaagcaagctccaatggaaacggatctaaggccaaagctggaggcgcttataaaccacctcacgcaagaagaacaggcggtggacgtattgtccccggagttcctcctggtgcagcaaagaagaccatcccagggctagttccgggcatgagtgccaacaaggacgccaacaccaagaacaggagaagaagagccaataaaaagtcaagtgaaacgtcacctgattctactccggccccatctgctcctgcctccacaaatgcccccacaaacaataaagaaacttctccagaggagaagaaaataagatctttactaaagaaattaagggctattgaaaccttgaaggaaagacaggccgtcggtgacaaactagaagatacgcaagttctaaaaattcaaactgaagaaaaagtgttgaaagatttggaaaagttgggttggaaggatgaataaactagaagaaactgatgtatccatacaactgtgtaaatattaacaacgtcaaataatactactttgaattgttttttactgtttcccaggagaattacgccaacctcccccctttctttttttcccttgttttattgtacttttccacatatttttttaacatcaaatagtaattgatacatacataattagtgagcattttccttatttttacgtctcttcttggcggattgccaccagccgcatcttacaatgtatgccacgataccgccaggcaataaatgaatatggagtgtcacttcggctccgtaagccggcgctgcatccgccaccacagttttttttagcgtcgctgtcgccgctttgccacagaaaaagaaaaaaaaaaaagaaacggcgccgtgtagggttttgtataacagatcggcctagcagccaggagatggcacggcgccaactgaaaagttagactgtggaattgccgttcaccacactcgagtggcatctaataaactgccacagttgactcaagcggtgctaccttcgcagttattgcacaccatggtaacacataacacagtcttgcattacaaatgtggttcctcctacttggcggtgaatttcttgagtcagcccgttattttcatatggtgatgtaagattacatacagtatatatatataaggatgattctcacacaaacttttccgctgttcatcatattttgtttttggattagtttcacattctgtagaaatctttaaagacaagagaagagaaaacaaaggcggagcaatgtcggaaggaagaacgtttctgtcacagttgaatgtcttcaacaaggagaactatcaattttcttcttctactacaaaaaaggaagtaagtaactcgacagtggatgctgacaacggtgcctccgattttgaggcaggccagcaatttgctacagaattggaccaaggtgaaaagcagttaggtattttgtcgtgtattgggcttatctgtaatagaatgcttggtaccggtgttttcgccgtttcctcgaccatttacacactatgtgggtctgtggggcttgcattaattatgtgggcagttggcgccattattgccatttctgggttatatgtatacatggaattcggtacggctataccgaaaaatggtggtgaaaaaaactacctggaggctattttcaggaaaccaaaattcttcattacctgtatgtatgctgcgtatattttcttcctaggttgggctgctggtaattccatcaatacagctattatgtttttaactgctgctgatactgaagtgaccaaatggaatcaaagaggtattggtgtggccgtcgttttttttgcattcctaattaattctctgaatgtcaagattggtctatatttgcaaaacattttaggtattttcaagattggtattgtcctcttcatttctattaccggttgggttgcccttggcggtggtctcaaagatggttatcaatctcacaactttcgtaatgcttttgaaggtactgaaaccgccactgcttatggtattgttaacgccttatatagtgttatttggtcgtttgtcggttactccaatgttaactatgcacttggtgaagttaagaaccctgtgagaactttgaagattgctggtcctacatcgatggtcttcttggctataatctacatttttgtgaacattgcttacttcgctgtggttccaaaagataagttaatttcttcaaaattgattttagctgctgacttcttcgatattgtgtttggcggccaagccaagagagcagcagccgcactggtcgggttgagtgccttaggaaatgttctttctgtcattttttctcagggtagaattattcaacaactaggacgtgaaggtgtgttgcccttttctaatttctttgcctcttctaagccattcaactccccaatggttggtttgtttcaacattttattgtttgtacagtaaccattttagccccacctccaggtgatgcatatttgctagtccaaaatttaatttcctacccaatgaatattattaattttgccattagcgcgggtttgctttggatatactggcaacgtagacaaggtaaaattgaatggaacccaccaattaaggccggtgtttttgttacgggatttttcacattatccaatttatacctgattattgctccttacgttccaccttcaaatggcgagtcggtgtattcaagcatgccatactggatccactgtgtaattgcttggggtattttcttctttggtggtgtttactacgttgtttgggcccaattattgccaagatggggccactacaaattggtttccaaggatgtgcttggtgaagatgggttctggagagtcaaaattgccaaagtttatgatgacactattggcgatgtcgatacacaagaagacggcgttattgaaacgaatataatcgaacattacaaaagtgaacaagaaaaatcgctgtaaccaaaaaggtacttaccatctcatctcgattcttataatcacgtatgaacattcttataattgcattttctttatacaaaatatataggtaccaaacctcattataatttctgccatttaatagtttaagatgctattccgtttcgtattttttcaatttttatacctactattgcgcgaaatcaaaatagcatactaagaaaaagcaatatcatgaattgctgatgagatagattcaaattggaattaactaaatctatcagcaacgctataaacacagataagcgctctataaaatcgtttgtctaacgttttatatagttctttattgctcccttaccctctttccgtcaatagtgattgttgtctcgggaaagcttttttttttattaatcaaaggcccaattgagttacaactgaaattaagctgagttggcggaacagtgtggtattagcgaagggaaaatctgtgaagtgccctagctacaaaacagagataaaaaaaattatatttcaagcatggtggagcaagataatgggtttttacagaagctactcaaaacacaatacgatgctgtcttccatttaaaggatgaaaatggtatagaaatatatccaatattcaatgtactgccacctaaaaaagaatatccagactattacattataataaggaatccgatatctttaaacactttaaagaaacgattgccccattatacatcgccacaagattttgttaacgattttgcgcaaattccttggaatgcaatgacatacaatgcaaaagattcagtaatttacaaatatgccattcttcttgagtcttttattaaaggaaagatcgtgcacaatataagaaaacattatcccgaggtgacatatccatctctaggtcgaattccggaaatattcgcagagagtatgcaaccctccgatttatcctcgaaccccattaatacacaggaaaatgatgaaaaggctggcttaaatccagagatgaaaatggctttcgcaaaactagatagttcgatcactgaaaggaaaccaaccaaccaagattacaggatgcaacaaaaaaactcaccagcgtttccaacccattctgcttctataacaccgcagccgctggcttcacctactccagttgttaactatgcaaatattacctcggcgcatcccaaaacccatgttagacgcggtagaccaccagtaattgatctaccctatgtactgaggattaagaatatcttgaagatgatgagaagagaggtcgaccaaaataataagacgcttaccctctgttttgaaaaactaccagatagaaacgaggagccaacctattactctgtcataacagatcccatttgtctaatggatattaggaaaaaggttaagtccagaaaatatagaaatttccatacttttgaggaagactttcaattaatgctaacaaattttaagcttttattattctcaagatcagagcaatnnnnnnnnnnnnnnagcaatataatacgagctcaactattggagaaaaacttcaatagattagtgcgaattgaattatccaaacctgatgaagactatttacctgaaggtgaattaagatatcctctagatgatgtagaaatcaatgatgagaaataccagataggtgattgggttcttttacataatccaaacgacatcaataaacccattgttggccagatttttagattatggtctactacagatggaaacaaatggttgaatgcttgctggtattttaggccagaacaaaccgttcatcgggtggataggttattctacaagaatgaggtcatgaaaactggtcaatatagagatcatcctattcaggatattaagggaaagtgctacgttattcattttaccagattccagcgtggggatcctagcacgaaagtcaatggtcctcaatttgtttgcgaattccgttataatgaaagtgataaggttttcaacaaaatcaggacttggaaagcttgcctgccggaagaactccgtgaccaagatgagcctacgatacctgttaatggaagaaaattttttaaatacccttctccaatagcagatttgttaccagcaaacgcaactctaaatgacaaagttccagaacccacggagggagccccaactgccccacctttggtaggcgctgtatatttaggccccaaattagagagggatgatctgggagagtattcaacttctgatgactgccctcgatacataatcagaccaaatgatccaccagaagaaggtaaaatagattacgaaacaggaacaataattacagataccttaaccacaagcagtatgcccagagtgaacagttcctccacaatacgtttacccactttaaagcagactaaatcaattcccagctccaatttcaggtcctcatcaaatactccactattgcatcagaacttcaatcagacttccaattttttgaaattagaaaacatgaataatagttctcataatttactatcacatccttccgttcctaagtttcaatcgccctctttattagaacagagtagtcgctctaaataccatagtgcaaaaaaacagacacagctatcatcaacagctcccaaaaagcctgcatctaaaagttttacattatcctcaatgattaataccttaactgctcatacctcgaagtacaacttcaaccatattgttattgaagccccgggtgcatttgtggttcctgtaccaatggaaaaaaatataagaaccatccaatcgacagaacgtttcagtagatcaaatctaaaaaacgctcaaaatctcggtaatactgctattaatgacataaatactgcaaatgagcaaataatatggttcaaagggcccggtgtaaaaatcacagagagagttattgattccggaaatgatttagtacgggtacctttgaatagatggttctgtaaaaacaaaaggagaaaactggattacgaagacattgaagaagatgttatggaaccaccaaatgacttcagcgaagatatgattgctaatatttttaatcctccgccgagcttgaatttagatatggatttaaatctaagcccatcctcgaataactcttctaatttcatggatttaagcacaattgcaagcggtgataacgatgggaaagaatgcgatacggcggaggagagtgaagacgaaaacgaagatacagaagacgagcacgaaattgaagatatcccgaccacgtctgcttttggcttaaattcttccgctgaataccttgcattcagattacgagaatttaataaattatgaccatgataaattcaccacatgtatctatatatgttcatgcatataccatatatattttgttattcatacgatagacctcaatcgttttgttgcctttcaaaacgcacaattgtaaacctagcttactatttatctatcgcggtccagaatggctttcctttttaaattcatcccagaagccacgtcggagtaaagtattcggccttgatgactatttcgaatcgaaatgaaagaataaaaggaactaggaggttgttccaacaattttccatgccgtaatttcatcggttattaggttaccagcatttatctcagtttatttgagtcaaggtaatttattttcattcattactgtatggagtaaaaatgaattccatttatgtattcgcacgaagagaaatttatcatccgtcagagacaccaaattacggccgaatttagatttgtttgcacgtaaatatgagccaatgaaagcgttattattcaatgtttccaaattgttttccaccgttttatttttccccaagaattcgcttttatgaatgtttttaatatatgcaatcattttatcaaatccaccgatgataaagttccagtgttcactcaacattttcatagaatcgtcatggcttctggaatcgactgttaaaataaaacaatatcttctttcattgcctctagcattttcatcatacagtttaaagcctataactaagttcaatcctctaagatcatcaaaaaatataaaaggcatattatcataaatcattgtttcttcagaaaaggctcttttaataatagaatttagcaattggtatcttatagaagaatattgggtagttataaacggaacatcttcgatgaagcaccgcatcgatctagttgactcttcaggaaactgtaaaagacatgattcgcaatatgattcagttggataatcaggcactagtaattcttcacctagcgttcccttttctgcggattgtgtaactgatatgatccttgggccatgcttgtcgcagaaatgagccaatgaaatcactgtcgaggacattctatgcatctatttcatcaaccatttaaacgctaacttattttatggaggtgctagttagttggactttattgcttcatttatcgtttgatggtcatcgaatagaagattcctaagcccttttctttttactcaagattttctttttcaagcgtgttttttctggcaagtacgaaaacggcatcttcgaacttggcgaatgaacaatcggtttggttcaacatttccaagaacaactacaacatactatcagtgttactttcaaaagtcttttaatacatttgaaatgatattcagtggaagtggaatgaaataggccacagtgaataggccacgatacacacagcatgtgtcatgctcaataccttgcacctgaatctatataatcttgtagttcaccattatatacataactcagaagaagaaaacaatacgcatattggatagtgctccatcgcttttaacaactgataatttcagtcatctggctcagggtcttgtcgattttttttatttagaaactatccgaataaaaaaaccgcaggaatacaaagcgatgggaattgctatttcactgaacatgtatgtataccgtataccgcataaaataactataaacctacaccattaaacgatgtgtgcaaagaagctcaaatacgctgctggcgatgactttgtacgctatgctacacctaaagaggccatggaggaaactagacgtgaattcgagaaagagaaacaacgacagcaacaaataaaggttactcaagcacaaactcccaacactagagtccactcagctccaattcccttacaaactcaatataacaaaaacagagcagaaaacggtcaccactcctatggttctccccaaagttattctccaagacatacgaaaacacctgtggatcctagatataatgttatcgcacagaaaccagcaggcaggcctatacctccagcgccaacccattataacaacttgaacacttccgctcaacggatagcttcctctcctcctcccctaattcacaatcaagcagtgcctgcacaactcttgaagaaagttgcacctgcttcgttcgatagcagagaagatgtacgagacatgcaagtggccacacagctatttcataaccatgatgtaaagggcaaaaaccgactgacagctgaggaactacagaacttactacaaaacgacgacaactcccatttttgtatatcatcagtagatgcgctgataaatttatttggtgcttccaggtttggcactgtcaaccaggcagaattcatcgccctatacaaaagagtgaaaagttggagaaaagtttatgtggacaatgatatcaacggatcgctcaccatttctgtaagcgaatttcataactcacttcaagaactaggatatctaataccttttgaagttagcgagaaaacatttgaccaatatgctgagtttataaacagaaatggaacaggaaaagaactaaagtttgataaattcgttgaggcgttagtttggctaatgagattaacaaaattattcaggaaattcgatactaatcaagaaggcattgcaaccatacagtacaaagattttatcgatgctacattatatttaggtcgtttcctacctcattgatgaaaaccattcgttctttctggtcgtaatacaaatagaagaggtaaaccaatcaatggcccgttagtttgccatttgctgcatccttcccatgcaaagtgtcttcgtatttagtgatgttttgttagcgacacaaaagagacctcgatgacagacatttttttttctttacttaatgtattataagtgtgtctgacctcgactatcattataatattaatttgaagttctattttacatttatatgagttattccattacataataaggatatcaagagcagattagtgtcttttagattatacatctttttccccccttttttgttgttggtagtggaaagaaaaggatcaattaacagaaataaataaataaataataaaaacctaaaattccttttgcgtcattgaatttttattatgaagtcaaaagggagtcggttgtcaacagactgtcctgtcgaatttcccaagatagtctctggattcgctgaggaagtgaaaatacgtagacaaagttcccaaggacagtacgccgtcgattcacatcctccgaaaagccctgaactgaaacacagaagacagaggtcatcctcttttgttaacggtaaatgcaggaacagggaccttccattgttagataacaagaaagcacaagaaataaacaccaattcacacggccaagacatcggtatcaaaaacttaccacgtcaacgtgagttgttgaatgccaaaaatggaattgattttacgctgatggtggcgggtcaaagtggattgggtaaaaccacgtttatcaattccttattttctacttctttaattgatgatgacatcaaagaaaacaaacctattattcgttataaaagcattgtagaaggagatggaacacaccttaatttcaacgtcatcgatacacctggttttggtaacaatatggataatgcatttacgtggaggacaatggttaactatattgatgaagaaataagatcgtacattttccaagaagaacaacctgataggacaaaaatggttgataatagagtccattgttgtttgtactttctgagaccttcaaataagggaattgatactttagacgtcgtaacaatgaaaaaattagcgaagagagtgaatttaatcccggttattgctaaatcagatttgctaacgaaagaggaattgaaaaacttcaaaacacaagttagagaaataataagagtacaagatatccctgtatgtttctttttcggcgatgaagttttgaatgcaacacaagatatttttcaaaaatatccattcagtataattgcatctaatgagtacatttttaatgaaaagggcgaaaaagttaaaggaagacaatacaaatggggcgctgttgacattgaaaatgaaaagtactgtgacttcaaaatcttgcaaaagacgatttttgattggaatttaattgatcttgtagaaagtaccgaggattattatgaaaaatgcagatctgaaatgctaagaactaggctattaaaggccagagattgcttaacaacgaaaagtgttgacataacggaagaacaaaggaaatttttggaggaagaaatgaacttcgatgaaatcgaggaaaacaaactcaaaaattacaagtgctatgaaataattaataaaacggtcatggataaggtggctacagaatgggatcctgaatttataactagacaattagaagctaagaaaaaattcaacgagctgtccaacagagaaatttcaaaatttcgagactggaaaaagagcctattcatggaacaagagaattttaaccaagagattgaacaattgaatcacaagttggaaaacttacaactggaatgtcaggacttggaatacaagctgttaatcggaaaaagttccaacagccattccacagatagtgctactttagtaaacgttcacatcaaaaggtagtattaattaaaaaaaaaaaaagccaataatttcgcgcaagctttgctctacataataaaaatacaattaggatagaaatgaatatttttttagcggcagttttaccataagtagcaaaaccctaacaatacaatgtgagactaaagtaaatccgggtaatacaaaatacaatttttttttattcttcacagcgttttttcgacggaggagggaaaaaaaaaaattgtatttaaggcatcaaatgcgcgacatcatatacctttgtccgctgttatcataccttgaacctctacatttcagcctagtgcgcgcaaaaagaaaaaaaaatcataagcaagagtggtacggtaaccacaaggcaatgcaaagaagggtgcgatatcaagtgatgttaccttcctttactttttgcctttttcttgaattgtcaatccgccctttttttcttttcagttttttctcctttcatccgtctcgtttatcataatgatgatttcacttatacctatatgttttttctggcatctctaatgttaggatgtgaagtttaagtactctccattcaatgaatacaatttttgacaatatctgattttactatgattaaacagaccgagggagaaaaaaaaaaggaactaaaaaagggcctacgtagaagatgatgtaaaagtagattcgcatctgagaatgttttcttcaaatttttcttttcggccttggcgcagaagactttctcttcgtccgcgtcgtataggaaacaaaaaagtgtaaaaagtaaaaatcggtatattacgcaatccattcgttacccggtgtagtcacgtgcgggtgcggagggcagccgtttaaacccgtttgggccttggtccgatagaaccatctcgcaggaaagagcagagccagttatcgggtgtcgtttacgcccagatgtcgtttagccagctccgcaacggccactgccactaccactgcctcccttcgtatacgggacacagagatcgtatacggtaaacgactagcactaggacaatagcaactaacaatgaccgataacagtcagcaacctcaaggcacctggcacaaaaccgtcgaggaagaggccctttgccaccgtatcgcatcgctttcccaccaattttttttttcttgcttgcctcgcctctgctgtggtcgtattattattattcattctctgcgcagtttaaactatatacacacgattaatccgttatgcatgtacattttcttgtatgcgtacgcctgtgtatgcatacttctatataatatataatacaggaggatctattcttttttttcttcttctcttcttctctcccttttttctctctcttcgtttctttccttccagtaaatctttatattagttgtaactttttctctttagatagtagcatagaggactaaggaaaagtagtacagccataaaaaaaagaggaaaagatgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaatttcatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaactaagagaagaaacatacttacaaaaaaaaaaaaagaaaaacaacaaaaaaacgtaataaaatagaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcaaacccattattaaatgctataaataaaagacagcttctttctaattattattcaaacttaaaaactacatatacaaaaactacaaaaatctttcaaccgacccatcttctggcagatctgaataatctaatccatggaccgtatccaccccactcttcgtatttgccctctggataccaggaattggcctccaatctgcaaactctttcaggatgtggcatcatggcaagcactctaccatttggtgacttgataccggcaataccattggtcgacccattggggttgaaggggaacctttcggtgacgttaccgtagttgtccacataccttatacaacataaaccatccttttcgaacttttccagttgttcagcgcttttagaaaatgttgctttaccttcaccatgtgcgacagcaattggcaatttggatcctgccatgccattcaagaaaacagattcctcgctagaattgtccttttcttgagatatttgcaccatacatacacgggcttcatattgttcactaacatttctttcgaaacttggccagttttcacacccgggtatgatatcttttaatctactcaagaattgacaaccattacaagcaccaaaagcaaatgtatcttgtctttcattgaagaacttagaaaattgcgagcgcacaccttcgtgatacaatacggatttagcccaacccgcacctgcacctaagacatcaccataagagaaaccaccacatgcggcaagaccgatgaagtcatccaaatggaacctaccttctagcaaatctgtcatagtgacatccactgagttgaatccagcttgttggaagcaccatgccatttccatttgaccgttcacaccttgctctcttaagatagcaacctttggcctttgactggataattctaatccgatcttcatatcatcggctgggttgtatgttagggcatactgcaaaccgggatctctatcgtccgtgatactggcaaactcttcttcggctgtttttggattgtctctcaatttctgcatttcgtaagatgtcttactccaagtttgctccaattcagatctcgaattggcgtaaattacatcatttgttgtggagttaataatcttgatttcctggctttggaaggatggcttaccaacaatagaaatatattctttagcaactccgttctcgttcaagattttttcgaacttgctcaagttcttagcagaaatctggaatactgcacctaattcttcattgaataggtttgttaattgactttctaggtctccaccgtcaatgttgatttctaagccgcatctggaagcaaatgccatttccagtaaagtgattagtagaccaccatcagacctatcatggtaggcaagcactatatcctccttttgttgatgcaattggattaaactttccaagaaacccttcaaaatggcgttatcatacacagtaggcgacttgttaccaacttggttgtaaacttgcaacaaagcagaggcacctagtgacttagtctcttgtttagctgatagatcaaccaagacaaggacagaatcatctgtgtttctatttagcaatggagtccacgttttactagtgttgaaaactggtgcaaatgctgtgatattcaatgacaatggtgcagtaacttccttatcatcccatttcatcttcatggacatggaatccttaccaacagggatagcaacacctaatgcaggacataaatccagacctaatgcttgaacggcttcatataacttagaaccctcaccttgatgagaggctggagacatccagttagcagatagcttgatatgatttaaagatttcacatcagcagcgaatatgttcaataaagattctgccacagataatttagcggaagcagatgcggagattagggcgttaactggtttttcacccatagccatggcttcacctgtggaaattattgtctcacccaaagaggtaccggtaacaccgacatccgcaacaggtacttgccaaggaccaacaaattgatccctatcaattagacctgtgacggatctgtcaccaatagtaatcaaaaatgactttgagccaacagatggtaagtttagaactctttgaatagcatcttgtagggaaggaatttcgctcaaatttgcctctggtagatttagtgcttcagttatggtttctcttgacatctttggaggcttaccaaataaaattggcatttctaaatcaattggagttgttttcaaaagaggatcttctacaatcaatttttgttcagcggttgcgtgaccgacgacagcaaatggtgctctttctctcttacagatttcctcgaaaatggataagtcttgaggagaaacaccaagaacataacgttcttgtgattcattacaccaaatttccattggtgacataccaggttctaaggagaggacctttctaatatcgaatttagcacccaagtcattgtcatgaaccaattctggcaaagcgttggataacccaccagcaccaacatcgtgaatagattggataggattattgttacctaaggcaacacaagcgtcaatcacttgttggcaacgacgttccatttcggggttccctctttgtacagaagcaaaatccaaatcggcggaaccttcaccggaagctacagaagaagcagcaccaccacctaaaccaatcagcatagattgaccaccaagtacaattaaacaagagcctggagttattggggtgttcttcaaagcaaattgaggtctaacagtaccgaaaccacccgcaatcataattggcttgtggaaccctctgatttcctccttcccttggtgattcaaaacctttgtagttaaagttctgaagtaaccgtttatacaaggtctaccaaactcattgttaaatgcagctgaacccaaaggagcctcaatcataatatctaatgcagatgcaatatggtaaggcttaccaatattcaactcccaaggttgttcattacctggtatcaaaaggtcgctgacagagaatccactcaaaccacacttagtcttggaacctctgcctgtagcaccctcgtctctgatttcaccaccagaacctgtagcagcacctgggaaaggagacacggctgttggatggttgtgagtttcgactttgataagtaatggaattctttcctttgtagaggtccattcctttgtagttgaatttggtgcaaagaaaaaggcatcattttcactatccaaaacggctgcattatcagaataggcgctaatagtatattctgggtttaatttatgggtatttctaatcatttgaaacaaggtgaattgttgttttattccatcaatggtccaatcagcattgaagatcttgtgacgacaatgttcagaattaacttgagcgaacataaataactcaacatcagtaggatctcttttcatagtttcgacgaatgcatgaatcaaatattccatttctccactatctagagctaaacccaattccgtattagctttggataaaatatcctttggagactgtttagtgtccttaggagttaaaggaacgtgaactaatggctttggctcttcatgtgtgaaaatactcatcgtatttggtggttcggtcagatataattgttgtgtcatcctatcgtagacacacttcaatgaaatatcatttagattttccaaaagagggaaacctggaacagtctttatgagtaaggctaaacctctttcaatacgttgaactttgtcttgtagcccgcatacatgagcaatattagtagccttggaagaccaaggagagatagtgcctgatctaggaacaactctaatcaaatatgtgtcttcgccaagagctgaactgggtaaattattagcgacagcatcgtttaattgtcttgctaatggatcgttagcaatatctaaagcagaatcgtaagtcaacaaaacttctagcaatttagtgtcctgttcagacaaattttgagcgatgccgttgacatagtgaatgtaacacgaacgcaattcattgatgacagaagtactgtttgtataggagtttatatctttaattagattatcgactctgaactgagataaggccttgggacccggcaaaatataatcagtcattgaacttgacttcttttgttatggacctgggaggattaaactcttagggatatcgctaagataaaagtagaagagaaatatacttcgaggcagggacagccaattatttaaatacgtatgtcaaggttttcaaagaaagaaagagttaaatagcaagatatattgcatttattacggcatcatctgtttaatgagtcctcattctaatttttttttttttttttctaatttcaagttcgacgagaaatttggaaaaacgggtcagcaggaaagagtcaggaacggttgaaggatattgaaagtcatttttgtttatttacaagctgatgtagaattacatatcctatctatgcgtcagcttcactcatcgttggtaaggataaatccaatttaatatgatattttgcaccagggagaatagctgtgatgatatccaatagagcgaaagaaggaatggagcctgtgaggacattgctagcataacgacacaaccgagtctcgatacgttcagtatactagtcattgcctcttggactcttgtcgaattccttgaaattgtctttataccttgcgatgacaaacttgagctaaacatcagtcggccattgagttccacgtttaataccgccagagtccccaccaaaatgggcgctagtagaggcattgctactagcggtgagcttagatcaaaggaactgaaacccagtgcggaaaaccaggaaggataaaaactttctataagctgtgtctctgttagggtcctgatgcccatggagactgtgacccaaagaggaatttgcaccattggcagtaaggcatttttccataggggtacattgtacttcttgaataattttttctgcctctttcttgtctctttcactgccaatagtgtaatttgttctggtgtcaaaacgccagcattctgtagttgtaacggcatgaaagaaccgttggagctaattctggcggcatttctagactttttattagtaacggctgccagtcgaagtttaataatgggcgttattggctgtactaatttcctcagttcttgttgtttcaaaattctcctccgctgccatatactgaatggcagcgtcacgagggttctaagggtcatagtagtcaaaggaacaagcactatccatggtatatgtgaggcttcatgcactgttaaaaacgtgtccgctacactttgaaaaagtgaaaagcttctctttgtacttggattagtcctaccatatcgcagaccgactgagctgcacgagaatgacgcaaaaccattttgacgattggctaacctctttaacataatgccatactttatcttgaaattttcctatccttggaccttttttttctaatgaaagtctttttagccttagttgaattactggacggtagaaaaattgggtttgccagcaaaaacaaaagtgcagaacgttaaataaatgaaagcataaactcatatgctagaatatttactaaaaaaaaaaaagtaaaaaaaattcattactattatacatgtgatatcagaacggaaggttttactcaacttgactgccatccctcggtttgtagtgaggcaacagctccacaacctcagctggtagtctaccatcgaccttgatggcgtacataccagctatactatgatctacgctcagccactttgctacccacgacttagtaggcttacacattcctacgaggccctcgaaagaaggcgacgtacattccattgtagaaacacctgcctcttcaaaaataccctgacagttgggacaaccatctctattaaactcatttgtggtctgcactatgccacacagcatacaggctctttcactagacatctcttacactgtacctcgttcgcttttgccaaactgaatgtggccaggtgtaattattacacagtacatccttcgagccctttcttaaatttcactttttcactcgatttcactcatagaacgtataaggtgacctttatcaacatcgagattaattatagatagaagatgattaaattatatacatgaatatatttatttgaggtatggtgtctaaagcgtaatatacctatctacttcacgtaaattggactacgaggaccgctttaaatagtagtaaccatctctttcctccatatttttctttacaaattctggaagctcttcacccttattactatcatacaagatgataccattacctagagcatgtttcttttcgtttctcttgtaaaaaaaaagtacaacaaacgtccataaaccgtaaatagcaccaaaaattaagctcacggtgtaaccagtcttaaaacgtggtgactccacggtaggccacgccaaggtaggaatccaggcgtaagtggattgagagaaggaataaatggcgatccatgtaatagccttcacctgaggatcaaaccttaagaagtcattaataaacgaccatagacaaggcgatgcggccacactgaaatacgtggtgaagaaagcgtaccatttagctttcgaaggaatatcccacttgataagtaaggcacaagaaacggtattcattatagcagcaaaaaccatgaatatccacttacatctaaataaatcggcaccaaaggcacaaaaaatcacatacgcaaatcctaaacatgcgggtataacactcaggttgttcacttgggcaatggagtactttgtattagactttaaccacaaagtatatgaaccactatacgcagtcatgttattccacgaacatgtatcaaaaacaacaagtacccagaatgctggagtacaaaatactttcttccaaagttttctgctccataatggggctagcttacttttatcaacaccatctttgatttggttcctcttatttctggcccttgcaattcgtatttcttcgtcagtcagaaataaagagtaacacttagatggtacaccgggaataacaaaaaaaccaataatagccgtgggaagagaaattgcaatggcatcgatcagaaacatccatctccagcctgctagaccatggacgccgttcaaacttttgaatatgcgactttgcagaagtcctgaagtcacggaacccaattgttgcccacaaaagaataaacagactcttgaattaatttcatctggggcataccaacaacctagtatatattgggacactgggtagtaagcagcgccaaaggcacttaaaataaatctgtaagcccttagttcggctagtgagtttgccctataacatgcaaatgtgaaccaagtccagcccaagtccattacaggcaaaataatatgagagggaaatcttggtaacaaatacataaatggtaattggaagacaatggcaccaacattagcaatagtagaagtgtaaacgtaatcattacctttcatgtttaaatcttccttcatattggaaacatatgcgttagtgtagttattcaaatccactgacttggaccaacataacataaaaaagtataaagcaataataatgtctagcttgtaaagaagccgtctttcagccttggtttgagtagtatgattaggatacaaaaactcgtaccacttacgtgatttcttgtattccttattaacacgatactcgaattcatcaaaatatttccaccatttacgcccagcttcatctctcacttcatatggcaagtcatgccttaaattgtgaggatgaggttctacagctgtagtttctgccgtaacgtctgtcttcgaggacttatctacgctatgatgtagctcctcttcagctatgatactggagttagtatcgtctgagtataagtactgatcatcttcgggtagttttctcaaatgtgggaagtagctcctccacgatttattcgaaattgtcattatctattgatttgtgtcggtccttttttgaaaattgaaacaaatgaaaaggcgattgctcgtgggtgtagagcctttatatatagttatgttatagccgtaagagtcatgcagatttttgggaatggctatcatcaaacttagccttgcatctcatatttcgactttttttttcatttcacacatttttttttcctttcacagttgggtgaaagagtctcggaggcggtacggcgctttctgtgtaaatcatcctaaagtgattcataatctcagagccatttcgggtgaactaatgatgattttctagtagactacggcagtatcttagctgacgcaattgtagcaatggaggcaatcatgttagtaaaggacattttagttgtaggagcataggatcgacaggccatgtgaaaggcgtactagcaaagattgaagtaatgagaataattgacgatgattttaatttgagcttttcaatgcagccgaattcagcagtagttgcagaaccggactaacacttgaaaaaatcccacgagccagctgccgtctaaggatattgtaataaagttgggcttaaactaaagtttttatatcttggttgtaaggttgtaatcattcgtctcaagaagaacgttgagtaatcattagtcctccgcataagtaggttgccaataacttgttcagcaatgatggttgcagcatatcctcgctaacgttttacttaccaaatattttttgctggtgattaagaaagcttctaccataagaacactatgtcaatttaaagcaataatgttttcctgagtgttcttgagcctctgtaaacgaatcatcaattcaagtatttttattttattgcaaggatatcgccaactaattattaaccggcactaatgatagaaatgtttttatttcgaactacaaaaagggcatacatgacgtggatatatgtaaagggttactagtttacttattgatgtaatatcaagaacaatgtgcttttaaaagagacatggttgacgagtaaacaaacatacattggtaattctataagggtctttaggcaatttcaaatccacttgagtaggtgttcaatgcgtcgcagttggttggaacgagttcgagtttttgaaacaattcacaagcgggatgatagtagtagccttccactgaacctgttagctggtctaaacacacatagtaaaatccctcaaatgacgcgccttccagatgatgattatcgtccaacatcagattttcttgttcctcatcatcaagtaggaacctttccttccatttaagataaatatatcgttgattcataaattctgcactttcatgattatactgaccaaaatttctttccgttaacgaccagttatcagaaccaaaatgaccaaacctcttccaatgagagcaatcactttctctctgagccatataagggtcgagcgtctcctcagcgggccaatgcagtgaacataacgggaattggttataattgatgacatacccttcaaaaagggtaacaactttatctaggactggtgttaaatttttaatagtgaaagtacctgtgacatgcgggtccaaagaacgcgaatccttgtaaagtggcaagtttacggtatcaatcttcacttccaccgtataatacgtgtactttgacgattgcgaaccgccaaatctcaatcctggcctcaaaaaatctaaatgtctaccaagggatctgtaggtatatttagcattcttacccactaaattggtcccttcctcgtaaacatcacagtcctcttcttttgctttgaagtgaggcaaacgtgtatcagttgaggagggtagagagacataggccgaagtatatatttcttcaatgttgtcatttcttttggccctttctagaataaactttcttcccatgatattcagtgatgtcatacctacagtatattttaaatgaaaagtctcataacacaatacgaaaggataaagataactcgtcgatggccatcatgattgccctttttatatgtttttatcaaatattaaactaaacaacatatacaattacatcatttttccctactttctttttctgtaatggttcatcgaagcatttttaagggtgccctgaagactattgttaaaaaaaggtaccgcatacattcgaaccattaccagaaaaaagaggggtgaaaagacattctaaattttgttatcgaatgtgaacagaacacttaagaaaacgccaaggttaagaaggccttgagagtattgattaaggcgcatggagcacaggtaaacgcgaaagacgttttgtacttccttttactgagcacctcttacatgtagtagtaaccatcgcagcggaataagcacacaaaaaatggtatttacttttaggcaaacttgtgggaagtattaaaattattatgtagatttatgtatatcgtttgtggttgtattaaactttaatgttattagtgttgttaacaacatttctttggccattattttatttggctaaaaatttcaatgtttttactttgtttattgtcagttgaagaagctgagaattcttgtgattccatgtttacctggggtgggaccactattgtttggactaaattgatattgtttcctgttgcccttaacaatggttgttccttctcttgttgcttaggggccgagttcacgtaggtgtaattactcgttgagataggttcaatggcttttatatctaatgggggcaggagaatcttattacagtttgaatctctctttaggaaattaggagagagtggcaaacatgatgctactgaaaacgatttcatatcagaagcaccagataaagaacctcttgaagtcttgcgaaacggctgttgaagagcaaaacaagaccaattagagatatcagtcaacaatgctttcgtctggtcattcaggtgaggggagtagattaagtatgggtaaagaatattatctcttaatgaagatacaatagcatgcagtagtatatggtaagcaatgaaggaatctgaccaaaaatcgaacaaaatggagtgtaagtctgtcaccaagttcttttggtgtgttataatgtagtcattcacaaacacttcaaccttctcaaattcctctttctctgttgatgaaaggtagctctgacgttgtacataaatggtatcgaaccagaaatataacattaggtgaacattggggtttactagtaattgagatacttgtgatggtgaaacatccgagcttgcaattaactccgatgaaaacaattttagttggaagctgacaatgtcggtaattaactgaatattccttgggtttaaagatgccagcgtgaaagacttcaaattaagaagcattgatatgattgataagttcgtggtgatcaaggtttcatcaacaaatgaggaagaatgatgaagtaagcacgaggtcgatacctgtggaaagttatcaatgaaccatatgttccttgtggtcccatttctcaaagtcaagttgttgatgaattcgaaccaaatcgtttcccacaataaccagttacttttcgatttgcagtccgtaatcctggcgttcataacgttcgcaaataaagaggggtttgcactagtttcaggtttgatcggctgctgcattacgaaacattcattcaagtaaaccagcaaatcatgcactctaaaatcagatggcagctcttgcggataagtcttctttattataaaatacacgtacgcggaatctgccaaaatattgatatgctttaaagttaagtcagtagtggacattgacggtcccttgtatatgaagtccttaagtggattagacgaaataaactcttgattgacgaaccaaccaaatattagtaaagaatcgttgttgaagttgtttgaatcgcgcaagatattgacccatagatcgaatatgaaccatgcattttccttactattcaaataatggtaactggaggatgccacggtgaatggcttcagaatatcttgaagcattgaaaacacatcgaactttttaatggaattagaaacaggaatgttattctccaacattactagaagagaataaaatagaatcaaggcaaaaacatcatgttgctctgtctgtgacaaaatgtcctcagtgtcaaagtcattgtcatgtttagatgagctagcatacaaattcgtacaacagataaaccatagtttttgagaatcttgatttaacgaaatggacatacccagacaagctattatgagaccaaaaggcttgttaatccaaaaactttccaccagctcgtcattttgtagtgatgagaacaggtctggaaagaaattttggaagatcttattttctaccaagtggcttacacccattctgaagaaagttagaatatctcttgagctaataaaatctaatgaatattcttgcaaaatttttacactgatggaggactccaaccggcttttaacctgcttaaagcggcttttccctttctttaaactagaggactccttcccaatcacacaacgttgctgcttatccattttttcaacattactactatgatagtgaatattgataaggccgctgttgaccttaatcatcgaattaacgagtgtttccattttgatatctctgggtgaagtcgaatcaacgtcaccaacgccaagtgatacagggatatcagccttatcgcctgtcattgacgcgtaactggataagaggaaggttctgtggacagtcctgatgtgtcgctgtaagagatcgcgtctaacaaaagagtgtttacagacttggcactggaaaggcttcacgcccgcatgagacctttcatgccttatcttgtgctcggatctcgagaaaggcttcaaacaaaaggaacatatatattttttttgacccgcagccatagcagtgataatgcaaatacaattactgtatatcaacaattgtcttctcccgagagaaggttttaaataaaagcgacaagtaaagctcttaagccatgccaactggcatgaagaagaaccgaaaaagaagaaatagaaagcagaaaaatgtaaaactaaactttataagtactttgaagatgcgttctatataaatatgtggggttaagtgaacatgactcgaaatctataatgcagcgattacgataagtatccacattaaacgtcaattattttgcgttgtaagcatatgcgcgggggagggggcgcacccttgaagtgcagtctgtctatcatattactgaaccatttccttcgcttgacttacatcattggcaacacatgcctggatcgctttagcggctacctttagtccatattttcttctattaccagatcccatcatccccctttgtccgattgacgaccattttgccgcggacgatcggaggggattgccaacgcggggtagccgactcggggcgccgagagcggggatcagtcatcgtcgcagtaagcgggtacggaccctgtcacgtaagacgatgccgatgcctgcgcctgcgcctgctcgtatgacggcactgtcagtaccaccgaatcggcgccgagcggctgtagcgccggcatgagatgatcgttggtgctctcgtgataattcggtggcggttgtggcagcgcgaggtgcgccgttgtagtggagttcagttcaacgcctggagtcagaccctgcgcggggtaagtggttaaaaaaaggggtactaattcgccagggcggaagtggatcttgccatcgtgtttatcaaacaacactagacggcctttcataggcagatgcggcgaaataaataataacataggtaattgcgccttgatctccaggttcttgtattcgccatccacttgacgttgtaaaagaatacgtacctgcaatttgtgcatgacacggattaggttgtcttgcagacagcagtcttgagttatttgtttgaggttatctggaattgtaaagggacaatcgacgtcaagtttgtccgtcagcgggccgaagtccgctagatgagtaattttcatgacggctatttcatcatcataaatttgtgcgctgctgtccttcattgcgtaatattggattagcgccatttctatcctatccaaacgaatgttcttttcgaaggggaaaatcttaatcttcacgggggttgtgctaccaataggaacagccctactcgggatggacgtttcgtattgcaacttgtcacgccaagtattacccacgctaatttcttcttgcatggcaagattgtccatcgataatgtacgaaggattctgagatacttgaactttttgatgataattttattcttcgttctcataccattgccgctcgtacttgtgctaccgattggaccgtgaggagaagtatgaacgctcagatcagtatcccataactgacgtccatctataatggcttcaaaggaatacagtatgctaccactttgtagtccctcgattgtttcgcacacttctggggggagcattgtattgaagggtagttcgtagttgcctcttttcattaggaataagtacgaacttccagacccgtctctgttactataactatggctattgttattgagggtgttactactactgcttctactacgggcgttttctcttaaaccctcgaaaggggttcctgtaacaccattttctggtagctctagtatttttctgtgggaagaatgggtctttcttcgaattattttgttgaaaacagggctcgaaagtgatctcttgcttagaaatattgcgttgccgctggtgtccatatcttggttgcttgtactgcgaccgctactactgttatgttgattttccgcattttccccaccgactaaaacatccccttttgaagaaaccaataagttgtcccaatagcattcgaaaatcttacgcttttccttaactagacttgccaaactactgctattcttcttatatcggccaacttgcaaaaactccaatttgaatcttcctaccaatctcagcgaaattttcttcactacgatctcatttttcactgaaatcactaagtttcctgataaaggtatagacgacagttccaacggtgacccttggatcaaaattatgtccttgtacggggagtttattctaatatcaaaataacttattctctctctttccttctgctctgaatgcccaccgctgctagatagcgaactaagtgaaaacatggtcttgcttcaccctattctcgccgagagctgtacaagatattttttacttttgccatcttatactcatcctaatcatctgtttcattttccttcttatttttttttttttttttttcttagttttcgaagaaactgcctttttagaattgtaaaagacgaagtgaagtattcaggagtatattattacatacatacaaagcaagacaaagaaacatttttagatctaacattttacttcaattgtttttgtattccttataataagaaagacctgctgtttaatgtgggagtaatccgtcccctactcgatcttcaataaattgtcatcttgtatctaaaggagcgctccagtactccaattaagcaccacctagtgcgtctagtgtcgatttttttttcacgcatacgtttgtatgtttcttaaatttcccatgattttttgttgccaatgtcatatctacaaactctatacgaaagtaaacgcacttcatcttttttgccctaaaacggcaatatttagacatatcataaggggcccaagggagaatcgttaattttaaacttttctttgctcttgaatgaaaaagtaaataaataaaactaaatcaaaaaaaagaacgccacgtttgaattttaaagcaaaaattttgttgatttagtaatgatataaataaaaccaagtcgttggtaagaatttggttaggttatgaatagtaatgaactggatctaagaaataaatatttttatgagatattcggtaagaaaagaaaatcagatacttcaacccctactcagttgttctccggctccaaagttcagacaaacatcaatgaaatttctatcactaacgatgaggatgaagatagtactgaagatgaaaataaggcttcattgaaggattatacactagggcacgacaccggtgcacggtataggatagcaccggactgttcttcccaccaattaaaggcatctcctgtcctacatatttcaacaaaccttaattcaagtccacaatccttcacaggcgatcagatttcacctactaataaaaaaatttcaataaatgattcgaccagacaagataaaggtaacagttgcactaccacttcatcaccttctcaaaaaagatcgaatgttttgcttcctcacgtaagaaaacattcatctccttcactattatcattttccaaaaacagtggcagtcatatgggggatccaaaccagctatctacgcctccaactcccaaaagtgcaggtcacacgatggagttacacagttcattcaatggaaaacatagttcttctagcacctcttctttatttgcattagagtcactgaaaacccaaaatagacgctcatcaaactcttccaatcattctagtcaatatcgacgccatactaatcaacaccaacgtcatcattcaaggtccaaatcaagtcctgtctctctgacggaaatatccatgatcaaaggcacgcctttggtttatcctgcacttttatcactaatagcaattaaattcaaacagaccatcaaattgagcacgcataaaaagatggggttactttacagagattcctttacaggaaaacaagcaattgatactttatgcttgatcataggaagcttagatcgtaatttgggcatgttgatcggaaaatcgctggaagctcaaaaattgttccatgacgtactttatgaccatggcgtaagagattctgtactggagatttacgagttatcttcagaatcaatttttatggcacatcagtcgcagagttctacttcaattgccaacacattttcttcatcatcttcttcagttaattcgctccgtactaaaactgaaatatatggtgtttttgtcccattgacacattgttattcctctacatgctctctggaaaaactttgctactctatttcttgccccaatcgtttgcaacaacaggctaatttacatttaaaattaggtggtggtcttaagagaaatatttcgttagcactcgataaggaggatgatgaacgaatttcctggacaaattctgtaccaaagagcgtatgggaatcattatccaaacaacaaatcaaaaggcaggaggcaatatatgagttgtttactacagaaaagaagtttgtaaaatctttggaaatcatccgagatactttcatgaagaaattattagaaacgaatattattccatctgatgtaaggataaattttgtaaagcacgttttcgcacatatcaatgaaatatattctgtcaatagagaatttttgaaggctttagcacaaaggcaatcattaagcccaatttgtcctggaattgcagatatatttttgcagtatcttcctttctttgatccttttctgtcatacatagcatcaagaccatacgcaaagtatctaattgaaacccaaagatcagttaatcccaattttgctcgttttgacgatgaagtgtctaattcttccctgaggcatgggatcgattcattcctatctcagggtgtttcaagacctggtagatattcactgttggtaagagaaataatacacttctcggacccagtaacagacaaagatgatctacaaatgctaatgaaagtccaagatcttttaaaggatctaatgaaaaggattgatagagcaagcggtgcagcacaagatcgttatgacgttaaagtgttaaagcagaaaattctattcaaaaatgaatacgttaatctgggtttgaataacgaaaaaaggaaaatcaagcatgaaggtttactctcaaggaaggacgtgaacaaaacagatgcgtccttttcaggagacattcaattttacctactcgacaatatgctattattcttgaaatcaaaagctgtaaacaagtggcaccaacacactgtatttcagagaccaattccactccctttactgtttatttgtccggctgaggatatgccacccataaaaagatatgtgacagaaaacccaaattgctcagcgggtgtgctcttaccccaatatcaaacgagcaatcccaagaatgctattgtattcgcctattacggtacgaaacaacaatatcaagttactttgtacgcgccgcagccggccggattacagacattaatagaaaaggtgaaacaagagcaaaaaaggctccttgatgaaactaaacatattacttttaagcaaatggtaggtcaattctttcactcatacataaatactaatcgcgtcaacgatgtcctaatctgtcatgctggtaaaattttattggttgcaacaaatatgggactctttgttcttaattatgctacatcgatcaatcaaaaaccagtgcaccttctgcacaaaatatcaatttcacagatctctgtattggaagaatataaagttatgattcttctaattgacaaaaaactgtacggctgtcctttagacgtaatcgacgatgcagaaaatgcagattttcttttcagaaaaaattctaaagtgttatttaaatatgttgcaatgttcaaagacggtttctgtaatggtaaaagaatcattatgattgcacatcattttttgcacgccgtacaattattgattgttaatcctttgatatttgattttaatagcggtaattttaaaaaaaacctaaaggcaggcttggtagattttagcgttgattctgaacctctgtccttttcttttttggagaataagatctgcattggttgtaaaaaaaatatcaaaatattaaacgtaccggaagtgtgtgataaaaatggatttaaaatgagggagcttttaaatctacatgataacaaagttttagcgaacatgtataaagagacgttcaaagtagtttccatgtttccgataaaaaattcaacttttgcatgttttccagaactctgcttttttctcaataagcaagggaagagggaggagacaaagggatgttttcattgggagggggaaccagaacagttcgcgtgttcctacccttatattgtggcaattaatagtaactttattgaaattagacatatagaaaatggagaacttgtccgctgtgtacttggaaacaagatacgtatgttaaaatcatatgccaagaagatcttatattgttatgaggatcctcaaggatttgaaattatcgaactgttaaatttttgagttgaccgcccatattaataccttaaaacttatttcttgaacctatacatctaaatttaagtaatattattttatttgtataaccatatgtagtttacctgaaatatatgggtgccattaagaaaatataatacaatggacaagaattttgtcctagaaaataaagtcttgaaagtatattgtcctttcctttggaatattatgtcactagcaagcatcgaaaattgatccagagtgaaaattaattttttcgagattaaactgtgaattcaaaagtttgattttaattgtttcctcactcaacttggtactgaagtcttgattagctgttagagaagataattctgaccgtattgaagatgtcgaatttactgaaagcaactgaagtaaaatatcgattacttcaatcttgtttttactgcttatgtaattattccaaattgaatccgagataggaatatgaatatcaaatgtctcttccatgggatttaggcaccattcccccgagttagagtcgttttcctcagataactcatgttttgtaaagtgagatccatcgaagctaatatcattatcatttaagtagtcatggtatgcattaggcagctcatgcgcaattctgttgacatagcgtaatagatcatcccgaatgatttggacaagtaatgaatcttctgttagtggtgcggttaacttggtgttacataaaagctctacgtcccgtgattctttcataaaaatggcctcgtagtcagaaagaagattattaccggaattccgaccgctctccccaccactattagaggaacgaaaattagttatattgataaagtttttaagataccttagaacaattttggtcatgttatgaactattttatttaccgatgttgtgccaaagatttcatttagaaggcttttactttggaagattgatggatacaggaaagcaccaatcaagtttacatcatcaagtaaataaaggtctttaacttttagaagccttgctaggattttttcaaagggctttttagatttggtgaatttgaagcttcgtataatctctgtcaaatataactcaaacttaatgataaaaaccaaggtatgggtaaatttcaatggagcggaagaagcaaagtactcaattgattgctcgaaagttcttaacgtctcttctaccgtgtttattagacgaaaatcggattcactaagtgattcattttctaaatgagagttgatagacttgaagaaaggaactaagtttgcaaatttttctaagatactcttcaaagctgaaaatctatcgcagttacaggaaaggattgaagtaagttcattgcagttaggttgtgtataattttggcagtataataggaaatccgattttagggagtcgtttaagttaacttcttctatcaaacagcatattttgccgagaatagtagatgataaatcaatatgggaaaaatctattaatgagtctaacaaagagcctcctgaatgattttctttggccacagaaaaggaagacagcattgattcagtaggaacattaaacaacggctgtaaaaaacaatgaagtaattcagatactatgcaagtatggtactttatctccctcacactcccgctatggaaagtaaaattatgactgtttctattctctagtaccattgtataatggctttgaggcaaagttatagaaatcaccgatttttgtaagccagggtatttcgaatacaaattgttgagctgttcctgccagacactaatatctatatccgttgttttacgtacaaaaatagataatggtaaacccttcgaaactttgttggtattatcgaacagttgcaaagaaaataatgatctttttccagccagttctgtaaaatttacagaaataagatgggataagtccaagttagacaattgtgcccgaatttccctagaatatttcaagtaaagaggttgatttgattccttactatcggataaatggatagtaaagggtaattgtgtatcattccttgatatagaccttctgatcaactcatcaattgattttgacaaccctataattgactcctctattatattggtagttaaaggagggatcctatgaaattttgataaaagagatttaaaggacacattctcaaagaagttcagcggtaaattttctgaggctatgactatggctactaattgggaaatagaaaggtaattactgctctgtaattttcctatgtcaaagcatttgaaactttggtcggaattgaaggttaacgaatcatagccgtgtctacgtgtaatttctgtgctggaagtattgtttttgagattggagtctcctactgtgaaattcatggaatagaagtttttattggcacttatattatgctttgttttcaagtgagatctaaaggtttttgtcaaacttgcatcgcttcttgttagtatctctccacaatgtttacatttaactttcgttaatttcttttcaattgctagaaaatgggaccagaactttgctatattcttcttgagcatttgaaccggaatccatatatttaacccatcatttatgatttcgtcttccggatgaattctacttgataggattttattgccgtctttttctataagttctatatcctcagtatcgtcttcttcctcgtcttcctcctcatgactagtagagtgagaagatgaatgatcagaattattgatgatttcgttatcttctaaagtcaccaaatccccatgtaaatcatccaatgcagtgttcatattaatgattgagtagattggtacatatgctatttcggaagacttttgttattctatggtttatcatccctttatttattttgtgtattgtttgctgatcaaaagttgaaaatttttcgcctaaaaagtaagatacaaaagaaaatattgtcgatgattattgcatgaatatatcagcaaagaggaaaggaaaacctactgagggacttacatttctgctgaaatatatagtaatctatcatgagcaatgtggctggggaattgaagaatagtgaggggaaaaagaaaggcaggggaaataggtatcataacaagaacagaggaaaaagtaagaatgagacggtagatcctaaaaagaatgagaataaggttaataatgctactaatgctacccacaacaatagcaaaggcagaaggaataacaagaaaaggaacagagagtattataactataaaagaaaggctagattgggtaaatcaaccgagaatgaaggatttaagcttgttattagattgctacctccaaatttgactgcagatgaattttttgccatcttacgagataataataacgatgatggtgataagcaagatatccagggtaaactcaagtacagtgactggtgtttttttgaaggtcattattctagtaaagtattcaaaaactcgacatattctcggtgcaatttcttgttcgacaacttatcagacttggaaaaatgcgcaaatttcattaaaacttgtaaattcattgataataaggataatattacaattccagatatgaaactgtcgccctacgtaaagaaattcactcaaacatcaaaaaaggatgccgcgctagtaggaacaattgaagaagacgaaatttttaaaacatttatgaattcaatgaaacagctgaatgaaaatgacgagtactcattccaagattttagcgtattgaaatctttagaaaaagaattctcaaaaagcatagagttagaaaataaaatagcagaaagaacagaaagggtgttaacagagctggttggaactggtgataaggtcaagaataagaacaaaaagaagaaaaataaaaacgccaaaaagaaattcaaagaagaggaagcatccgctaagataccaaagaaaaaacggaacagaggcaagaagaagcgtgaaaatcgtgaaaaaagcaccatttctaagaccaagaacagtaatgtggttattattgaggaagcgggtaaagaggttttgaaacaaaggaagaagaaaatgcttttgcaagagaagttaaaaatatcaaactcctctcagcctcagtcatcatccgctcaaacccagccgtcgttccaacctaaagaaaaccttttcgtaccacgagtaaaaattttgcatcgtgatgataccaagaagtagtaaaagctcatggcttcttatatattatatatggaatacatttataataaaataataagaattatatatattatgattatattattacataaagtattccccattataaattctgagtttcgtatttaatgatttttcaatgaatatttaaaataataaaatatatgaaatgttcatatacaatgaaattgtcatgaagaaagatgactccaagtatcgtttataaatcgtcgagaaaaagattatgaagttggttaactttttaaaaaagctgcgcaatgagcaggttaccatagaactaaaaaacggtaccaccgtttggggtacactgcagtcggtatcaccacaaatgaatgctatcttaactgacgtgaagttgaccctaccacaaccccgactaaataaattgaacagtaatggtattgcgatggctagtctgtacttgactggaggacagcaacctactgcaagtgacaacatagcaagtttgcaatacataaacattagaggcaataccataagacagataatcttacctgattccttgaacctggattcacttttggttgaccaaaagcaacttaattccctaagaagatcgggtcaaattgcaaatgaccccagcaaaaagagaaggcgcgattttggtgcaccagcgaataaaaggccaagaagaggtctatgattcgctgctggtgtcgttgtcatcttcactgtcaccattactttcgctttcgctagaactactctcttcatcagagttgtatattttattccattgacatttccctaatggaataccccagatatggtcctgtgtggccaaccaatcgactaattcatcaatgtgtattatacaaagttcttcgttataggagtgagcaaagcagtctacttgtagtgggaaactttttagtttgaaataatgctgtgaatatttgtataattgtactttaaataactttatcaaatcattttcatcatcatcgtttttgttattgccattcaaataataatactgtaaccgcgcataaaccagaagcaaagcaataatatatttcgagtcaaaaccgttctcattttttacattcaataagaagttcaactgctggaaattcggtctgatttcgattaacttcattaagatgcatttaaactcaatgccaccgagaaccatcatgtgtaaatgaccattttgaccttttatggtaccaaatgcgccaatcataactttcaaaagctctaccattgtattgcctctcaaagattcgttgcttagatttactttatagtacattgaattatgaattttatctcttgtcaaccgaggaataacaagtgacactgactggttattcagttgttttggagagatgttagactccacttgaaattcattgacagccattgtagtccttgttctttacccacgttttgtttttgttcttgcgtttttactgccactgaaaatatagcgttgtaatggctttagattttacttttttttatcataattcttgttcagaacgttcgttattgatatcacaaaattatttacatgattagacattaaaaacataaaacagtacacatagggtttactattctaaactatagttatcttctctcttattcttcagaaccagcctatactttggttttttttcattttttctactctcttggcatacttcgaacccttcttggaagcaatcaactcatctaccttctttaaagcttcttcacgtttttttagcttttcgtttaatttcaattcatgcttatgacccttgggcaagagaacacctttcatgagggtctttttattgtatttctcctcgaagaaaagtttcttagtgttttcgatcggtggtaaaaactcttctactccataacgcagtgccaacttatatacgtcactcattcttctaagtgaatatttcggatcatgaaatcgttgtgtgaccggatgtttatttggtaggaaagggttggcattaatggctttagtagatgtagacactggagaatacttgattgaaggggggtatctttggaaaaaggacttcaatttcaaaggcaaactatcaaaatactgtttgtatgacatggagtttagtttaatgcactagttgggtttcctattttgtataaatggttcactttatttcgtatttcacttgctcttccactttcacttgtatcccagtcattttttttttttgtttgagaaaaaaggaatataaaaaggcgctactataaagtacttaatgatactataatttagaagattgacttgataagaccgttgtgtaccaccagtcgatggctagggaggattctagactcgaaaccatttcccacaattgttgaagtagctttttgttatgtgtattgattagctggagacagatgttcaaccagccgatcaaatgatgaggattgttgataaaggctatttgtacaatcagacattcaatcaatacattcttcttctctgggttttttacattaacaattctgatatacgtctcgtgcaaagagtccctaagcaaatgcttgttataattatgtagtgagggaagttgtgtggatagatggccgaatataagtaaaatttgatttgcggacaatttacctgcaataaattggtccatcgacatctttaaatagacgagtatgcgggatacttgccattgtgcaacctgtgaggaataagaagagtctatagacagtacagtgattgtcaatgtgtgtatagattctttgatttcaatatccaaggcattgcccgtcttcccgctaaaaaatacatcgaaatgcagtaaaggttcgataaactcagtaataaacggcaaacgaatgcgaaacccatagtaattagtaattttgtttagaaaattgatgtaaaacactaatttatttggatcttgtttggtgttgtttcttttcattagttccaaaactgtagtgattttagacaagtcatccatgacaatgaaatacgttactaaattatcgtaaacataatcgtaactgggaaaaccgactgtcccgattttttgagtcaatacgtggacgtggaaaaggcttaaacagatcatagaataaaaagtgtctttatggttaggcagtattgtcatattcatggcggataattcttttaacgcgaggattatcaggataaatacattttggaacttgaaatctagttgttgttctttcaacgaagccacagtatcggacaagtatcgacatatcctttctagtttgcgtactgaatttaccaaagttgcctcatttgacctcgtgattgaaccggtcaagcaactggccaaatgattcaagttggttgataagactgaattagtcgaaaaattttccatcggctgcacaatgccgtgtacatactcttccaaaaggtccaatagtttctctgtgaccaaattccatgatacgtcaactccgtgcaaaagggcgcttcggtttgactgattaaaaagtaaagctaatgctatcagaaggcaatgctgaatcgataaattagccttgacaatggcagtattccatagctgcgcccatattggtgaaaacagttgtaatttccagtttctgtaataaagcgcagttttgttgctggattcatcaataaaataggcgttgttcaattgtttgaacctcgggtatgtgactagtacaccatccaaaaccatcaactgtgaaaggttccacgtggctcggtgagattcgaaaacagcattccaaaccaagtaaaacttcgaaattgggagcgtgggctcagaaacttccagtttccaaaggaaaacatctttgacgatgtgcaaaaggcgtagtggtggtaactggacaatgaactgcgatcggaaaagtgctccgaccaagcgatacaaagtgtcgggggatttgactcttgggacgtagtataccacattggccgcgatttcgtctagcaggcgttgatcatactggattctcgtttcggaagagagtgcagtgatcagatattcgacgtcatgatcaaacataatgtcctaatgccctctgtaagtgcggttttgcgcgcatacatgcgtattcatatttcccttttgcatttgtcttcttcggttttcctggtagaatttcccttaatgggagaatagtaacaatgcaaaaaatgaagaaaattgagaaaaaacaaaaaagaaaaaaaaaacaaaaaagagagctatgtaggttgactgtgttgttctatgtagtgccctttatttttctttggatttaaattaacagatacattatatcttgaggtttttagtcccttcttgagcctgcttcaagtcttgccttctctgaacgtcccagttatacaatcgcgcgcaattgacctccattgtcgtgatattttccctcaaaaactctacgtcctcggtggacaccgttaaagactgttcggaatccgcgagtttcttctttaacaactctatggcctcgtcgatgggatattccagcatcacgtctgcgccaagccacaacccaactttcaaatccgcccgatcttccggtatatcaacctgagcctttgtgtagagcgtgtcgttcaattggtagtgcaacaggataggttcatcgctctcatcgccctcgtcgctgtgattgcgcagactttggcatatttttaatgtgttttccaagtccgggattctagtcttcagctgctttatcgtagccaatttagattcctgcataaatttgtacttagaaagccgttcttggaacttattgaagcacaattcgaagtcgcttgggtccttaattatttcgttgacattttcgatgaatggagcctgcggtatgcctctggcattcttttccgtggagttgaacagtgtgtccataataaccgtagtatctgttatatatgtgcgtacagttttttgcagtaaatgttgtctacaatttatagcctctacaatagtgttaaactagatttttcactttcttttctgaccagttctgcaaaatgatcgaagaaacgaaacaaatcatgtgttacccgtcctgcacaaatcatgagtgcctgcggtttccatattggaacggcaccttccttttttggaagtcacgttcctgcagcgcgttttttttttttttatttttcggtttttttcgcacgtttcttcttggtgagcgagaaagctcgttgcctcctaatataaaggatgagatgagatgagcagtgccgcaaatgagggatgtgtttatttgttcattgtcgttttgcgattatcttcgtttccatgtgttaactcattcattcattcatttactcgttcacgcacacgcagcagttattccctcgacgagcgttcacttgtatcatatagcatagtttacgtagcaatgaataaaagcagcaaggcatttcaggtaccgaataaggtcatcaccaaggaggatattactcccttgtccagatcgcacacaaagaaagcggacactcgggggacagcagatggtaaaaacaccacagccagtgcagtcgaggccaccccaatcatcatcaccactgctcgttcgatagatactgccggttcactatctgagaacgccaccgaggacgatggcacccaaaacggagatttacacgatgatgacgatgatgacgacctcgaaagtacgctcggctatagttctgagcctgatcctctcttctccccatgccaccagccctccttcaccaacagcacatttagttacagtgcggacaatgaactacccatggaggaaaatcacaacaagaataatttccacgatagcagcgagagcagtatctttctaccacagatacagcaatcattctttttcggcgacaatagcaagagtgacgcaaataatacggacttctggaaggaagtaaatggcactgcagaagaggccatttgcctgcaggagacaagacaaagaaaatgctccctcgtggctctgcatccaggcgacgccaccacgagttcgaacgacacattgggaatagaggacttcatcaaagatgatatcaacagtgctgaagccatggaaccctccccatcttcatcaccatcttcctcccttcttgataatttggactacaatatcaagttattgtgctacagagacaatgagggcaagttcaccttgaaaaaaaggaagtttttgaagaattccctgcgctcatcctctgcaatttctaaaaagtggaaacccttgtctaaaagagataagctgttgaagagggccataagaagaaagagtggtgtttgccagacgttatcagctggttttggtatcggtgaattcatgttgtaataacagtactattaacagtacaataaatagattctttttatacagtgttagggtaacttgtttttgtaggatttgaaaaatatgtcattataagatctatatcttttactatttggacaagttggctaatttgataggcaattgaataagaaggaactctgtatctcaacacatcacatgtctactcaatccggtatagtcgcagaacaggccttgctgcattctctgaatgaaaatctttcagcagatggcatcgtcatcattatagccaaaatttcccctgattctacctcggtacatcaaacgcaagtcacacgtagcttcgaggaactggtgcagttggcatcacaagaaagagaaccgttgtacatcttctataagccggaagggcttgctaagtacttctttgtgtcattcatccccgatggttctccggtaagatcaagaatgctttatgcctcgacgaagaacactctggcaagacaggtaggttcaaactctttatccaccgaacagccattgatcacagatgcacaggacctggtggatttgaaaaattttgatagtgcccgtcctgctggccagaataagcccttgacacatgatgaagaaatgcaaatcgaaatcaataagcaacaggcacttttgaggaaaaacacatccgtcaagttggtttctcaggacagtgcttcgcctttatcgttaactttcagggtcaattctgagaagcctatcaatgaaatattggatagcgagggtaaaaatttaatcatttttcaaatcgatccctcgaacgaaactatccagatcgtgcaatctgatacatgtccctccgtagatgaactgtacattgacttgcccgggccaagttacacgattttcaggcagggcgattcaagtttctttatctactcttgtccctctggcagcaaagtcaaagatagaatgatatatgcttctaacaagaatggatttatcaactacttgaaaaatgatcaaaaaatcgcatttagtaaagtggtagaaattggcgattttgtggaactagacaagtccttacttatggcaacaaataaagaagacagcctcgatcatggatccaatccagatctcccaaacaaaagcaatttgaaattcaacaaaccaaagggcccattgaggaaaagaagaacatagagatagaaatggcatctatatatgtgtgaccaacaatacatacgtttttattcttctaaatatgaaactgaatttttttctaggtttgctggaatatatattacactggcaaaaattgttatgctatgctatttaatgttcattgtttttgcagcttgataacctctcttaaggcgccaaatggatttttttggaaatcttgattggttaggacctgattgaatcttgcagtttcgttagcagccaatgcctttgcacccttttggttcctgatatttggctgattcttttttatcctaacagaaccaggttctatctttttcaagtttatttcctttgtgtccacaaaccttattttagaattcatgtcgatgtcatcatcgttattcatgtctttgctactattttcaataatgccccgtaaatccttttcttgctccaaagaagtgagcagatcttgcattcttggttttagttcttctcttagctttcttttcctacgtctaatggaagatttagaaataccatcaaaattggcacctatgccatcgctaagtgtggatttccccttcaagttagataagaaagtattctgtctgttaagtagctttgcctttttagtttctttaggttggtgcagaaaggcccttggatcagattctatgtcataactctcgtccagaatgccattgttcgctacgtctggtccaaaattttggctatttcttgcacttgctttgcttctaagcgtgtttctcttcttagcaaccattatcgcttatctatgcttctatattcaatggatttcctgtctcttatctctgctcatcgagtctgtaatgcttgagtatgtaaaacatgaaaaatttgcagtgcgtcacccgttcagtttctcgcgccgaataacattttttatacaggaatatttcaccttgataatggccgacatttacgttatttacctattgtcccttcgcctagacctacaagaaacattgcctcaagtgccaccttcataaagtttattttctattatgtcccagtcgaaccctatcttacgtggcctcgctattacaacagccatagctgctctatcagccaccggttatgctatctactttgactatcaaagaagaaatagcccgcaattcaggaaagtgttgagacaaagggccaaagagcaggccaagatggaagaacaagctaaaactcatgctaaggaagtgaagctgcaaaaggttaccgaattcttatccatggaattagccaaggaccccatccctagtgatccctccgaaagagaagctacatttaccaccaacgtagaaaatggtgaaagattatccatgcaacaaggtaaggaactggaagcagcctctaagttttataaagcattgactgtataccctcagccagccgatttattgggaatttaccaaagatccattcctgaagccatttacgaatatattatattaatgattgccatcttgcctcctgctaatgtggcttctttcgttaaaggagttgttggaagcaaggccgaatctgatgcggttgctgaagctaacgatatcgatgactgagagtaacattttgcttgctttttttctccgtttttgtttcttttactctgtatatagccctatataattacatcatttctctagcctaaatcttgttatatataccaagctttttggaaagctaaggataaaaacaattcttttcattagatgtattttttcatcgtattaggtgtaatatatatatatatatatttataatatatatgtagtatacacacgtggacgaccattaacgaatgttgtatatgcttatgcggaacctttgtactctcttaaaataacagggacagatgaaggtggcaaagcgccgaattcagtgatcacttttttaatatattctggtggtgttaaatcgtataagatgttgacaatatttaacgaaggtaactcttgccaaccatccaaaatatttttgctgttgctgtcttcttcattactggcgtccttgctttctccttcagatcctttcttaccgccaattttattaccctttggcttattctccattgctagctttttcttttcaaattttctttctttgataaattggtttaataacgcacctttattaccgcgtctctcgactggattttcgtaatctatattaaccaggtcatttggatctgccagttcattaaatgtgacactatccaattgtactctttgtgaaaacttcaaactttcgcaacagactaatacaggtatatttcttctcttagcgctcatagccaacattgctgtcccagctcttgaatataggaacccattggataggatagaatgggctcctaaaaacacatagtccacatccatattgaatatcgtatccaaacttgtaataagagcatacataacattgacaccagcatttcttaaagtttcggccattttccgcccttcaaatagtggtctcgaatcgaccacaatcactttgatgtttttctttaaactgattgcattatgcagtaacagttcagttagaacctttgatgaaccatatgtcacaatagtagtagattcttcaatttgtgtagaggcattgtctataattagttgatcagccagttcgattttttctttagcaaactgcccaattttctcacaaaggtcttttttggcggctttgtcgggggtagatgggtcaattaatgaaatttcttgctttaaccacctgatagcattacccatagtaacacttaaaggtctagcttttttcaaaagatcaatctggtgtgacaaataacttgttaagttacgtgacaaggtagttcccttaggtgtttgatagtctttgataacaatttggaaaacctctagcatggctatgcaacgtgggatggatcctactattttatagtgtgctagatgagaagttaataataatatcgacggatggataaggtctttattcaataaaagttccttaacagacgataccaagctggagttgtcaaatgattgttctaacacggtagggatcactgacgatataccgggaatgacattaaactcaccagcctctaacgagatagatgccaatgtcttggcaacatcagaagcgtttgacgaagcaatctcttgttgtatagctgttggagtatttgttgacgcagaactggtaccggcagagagtgctgcagaagaggcaggaagagtcgttgttgttgaagctggagctgatgcagatacagtagacgacgcgtttggacccacgggcatcaaggaagaagccgttaatacgttagatcctgataatgcactagccaccacggggaccatcaacccagcagcggtgattcgcgaagtttttggagatgatactgcactggttaaagctaaaattgtcgctcttctttcttcagtagtttccagatgaccaaaaagtgtgctctttttcacgtttcgttcattttgtttttttttattggcatttttttgcttttgctctcttttctgttgttgctcacgttgtagttgtttcttctcttttttcatttgtgcttgttgttgctgttgttcaatggatataccattagcctgcttcattgcagctctctttgcagctttttcttgtttctttagttcttttagctccttgtttgttaatttcttttctccattagctgcagctgtagttgttggagtagcttgtttagctttacttggcggtgtagccgacctagatttggcttccgattcgctcatagcaatttgattatcgacgcttctttgacaacgtatttcttacgtggtgaaaataggatcttatgcacttacgctgattatctgtagctggtgatgccttgttgtagaatactcattttcactaaactcgaaaaaaaaaaaattgaaaaattggaaaaaagcgagaggtactgaaaattgtgaagagattcccgggtaaatataaacataattatataataacagcaatatatgtgacgaactgtgttctactttttagtatttacaggtatgtttatttatatatttcctatggggtgttttggtactatttttcctctttttcggtggattcctgaggaggtggtgtttccaacagtcccaacgctttcaaatgcgtgtcgtatggatcgctggattcacttaatgcattttgatattggcgtataaattcttgcaattctaggtattgagcattgtgttgatcgatgtccaataatgttcttgcaataaggtatatcccctcgtatttgcttagcaagtcctttagttccgggccacttgatgaattagggatatctggtaaactaatatctacaggttgcaagcccgtcagctctggggtaaatccaatctgtctacctaatgttgcaacaagaatatttgctagtccagtattattttttctatttaatacctttttccaagcaacctgcagtttcctctgagcaatttctgcatctttatagtttttcaacctatttcgatgcaaagcacacatgatattagtattaaaaaaatgctcgatatcaaatacggatggattttgcgctttgagaaacttgtgctcaataccatataagagccctaccatgtgcgcatatttaccgattttgaaaaatgacgcagtcaacatcttttgaacatgaattggtgagatgtacgtccaaatagcgcgctttcttatggaggtccctgtccattctttgaaccaatctagtagttctgtcgagttgggtccaaccgaataaataaaatcatttaacgtttgcttcgacagtggctttacgggaggtctcggttgtaatggttcccttgtttttggatccctaatatctttagttaacaatatctgagcattcttgggacggtaaatgaatggttttagtttcgcatctgtcttgtggtatatcaagaattcatccagctttgctttcgcaatttcgccggtagatgcaaaacgtctccaaactgtacttctgaacattttcttgttggtcgtggctcggtgcaatgcccttatcaacagtatcggtccctcattaatcaccactgttatggttcccattttcttaataagaaaggtttagcttttttcagcacattttctattaccctgcatggtgagtatcaaataagtgccaataaattgggtatgaatacaactaaatacattgacaaagtgttcacaacgcatcgaagcgctagacttgcaaatgtgatgaggatatatgatatttttgggatattttacttgttcttatatattaagtagttgatgttgtcactgactataccgagaccaaattatttatcgagcacatcagcgtcgtacttttgcttgaaccaagagacggtgtcttccttagttgtcttgtgggagttaccaacagtacccttacatctctttcttctagtgactctagcacctggtctgttcatgacgacatagaaatccataccgaaaataccgatggatgggtcatacttgatacccaagtcaatgtgttcgtcaataccgaaaccgaagttaccggtagcagagaagtttctgtctctcaattggtattccttgaccttcaaacctctttccaaaatttcttcagcctttggacctctgacggtaacgtgaacagcaattttttcgtttcttctgataccgaaagttctgacagtgtatctggccttggattgaactggagtttgaccagacaattgttctaaaaccttggaggctctggttaatctgtcaccagattcaccaacggagatgttcaagaccaatttctcgatcttcaaatcacgcatagggttttgggctttagtagacatcttggacgcgtatttttgtatatattgggctttcaagggtaactgatgctaaacgttataatacacgaaatgaatgcctctcttaacagtatacttctttaatgatgagttatgtccaagtttcactttggtatcctagcttcgctattcgcagagcgggttccaaaagatcttcggataaaaatgaaagaaggcgatgaaaacaaaaagaatattgaaaaaaagtaatgtatgggttctcgtggtacggatgttaaaaatgtcttgaaaaataccaattagacgtttggttctgagcttgttatatatagatgtctatacgactcaacatatgtatgttgctgcattttagaaaaaaattaggcattaaacattaggctacacaggaaataatgtttcctatcaaaagagttctaacttgaattgttccttcacaattaaaaaaataaaagagtacatatttaggagggggaagagatattaataatagactaaagtaaggagtgaggagagggcaaaatacaataatagatgaaaaaaaaaaaataggaaaatgaaacaatttttttcaaagtgagggaacagaaatgattatctgtccacgcattaattaaaagagattaattagtatagtaacttgttcttttctgctggttttttttttttttgtttctaatagattgttgatttattttgattaagctgttgtttgttggggaagagactcactttgctggtgtccgacttgttcatgttcttcaacagcgccttcttcttcttgttcaggttcttcaatttgtccatcttcttgttcgtcttcggaccacctgccttgaccgtcttcctcttcctcttcttcgccttcttcaggttcgaagtcttcgtaatcctgcttgaaacttaaagtaggcttgacttgggcagagtctagtgtccattcattcagtgcgctttcagcatcaataatgatttgtttagaggcttcatacccatcgtaagcaggcctggtttcacctggagtgacaggagagtcgtccaatagttccaagagagccttaccgtaaccagcgattaaagcaattttttctgaatgttcgatgatggagtcaaattggtagttgaaagcagctctcaactttgaccttgtgatattagataattgagcttcagcgaccaaagattcagcctcagcacgcaccaattcttgttccaagacctcaatcttaggtgattgaggatctttgtatttcaagtaggcgattttgtcggtgatcttgtccttacggtctctagatggttgaacagaaccttcgatatctctgatggactttagagtcaatctgtattggtcgtaacgatcgataaattggtcgtctagttcactaacttcatagatcaagacacctaatttatcagtgatgtcggaaacatcgtcatcgttttccaacccccaaatagacaattgcttagcagcgtcacgtctttcgttggctgtcaattccatggacctcaaaacattcttttcaatcttaaccaattgagacaactttctggataattctgggccaaaagctccagcagcacttctcctaaagctgtaagctagaccacccttcccaaagaatctacctttggttgtagatggtggtggcggtgggttctgtaattgagaggcggtaggtgccctggaatttcttaaagagtaagttctgtgcatactatgtacttgatgctgatatattcttcactttgcaatactgctaacaatggaaaagtataagtaaataaatgtgcagatgcagatgtgagacaaattttctttcttggattgggataatcaacgcattgtacccaaacgacgggaaacaaggaaggatgcagaatgagcacttgttatttataaaaagacacgggagggggaatcccgtctttcgtccgtcggagccaaagagatgagccaaagcagaaaaacaggggacgccgcccttcttccgtcccgtgcgtgaggggggcgcggccattcggtttttgcaatatgacctgtgggccaaaaatcgaaaaaaaaaaaaataagaggcggctgcggaattttataagacaagcgcagggccaaagaaaaaaataataattgacgtggctgaacaacagtctctccccacccctttccaaaaaggggaatgaaatacgagttctttttcccaattggtaaatattcaacaagagacgcgcagtacgtaacatgcgaattgcgtaattcacggcgataacgtagtatttagatttagtataatttgaaccgatgtatttatttgtctgattgatttatgtattcaaactgtgtaaatttatttatttgcaacaataattcgtttttgagtacactactaatggcttattgtttggcatttgtagcggcagtcaattgcgcttgtttgatcaaactttccggagcatcaaagacgggcagtttcagttcaattagtctgatcaccgagtttttctggaactctgaatcagtggttaaggcgtcccactcgcccgtagtggcgatcttgtgattttcgtactttttcgcaccaaatgcgggcaacagggcgaggtgatcccaggtctggatttcgttgtactctgcgtgaggcccatgaatcagcttttcgatagtgtagccgtcgttgttaaggacaaaaagatacggctttaacccccatctgatcatggtggagatttcttggacggttaactgcaaagacccgtcacctatgaataagatgactctcttgttggggtcaatctcctcagcggcaaaggcagcacctaaagttgctcctgttgtaaaaccgatagacccccacaacacttgcgagataccgtaggcgtccttaggaaagatagtttgattgataccgaaggcagacgtgccggtctcggaaatgataacatcaccttcttgcaagaacttggacaattcgttccacaaccactcttgtttcaagggcgtgctagcaggtacacctttgtttgcgggagttttggttggtacgggaacgctcttgtagcccttaacaacatcgggaataaccttcagtaagttttgtagtgcaaatttcatttgtacgccggggaacgtagcgttcttcacctttacgtaatcggaatgaaactccactacatttttagtcttgtaggagtaggaaaacgaacctgtgttaaaatcagagagcaaagcaccgaccgaaaggatcaaatcagccgactcaacggcctgtttcacgtctggtttggacagcgttcccacataaacaccgccatatctgggatgctgttcatctattgaccctttacctaaaggtgtcacaaaagctgggaattgcgtcaaatcaattaacttctgggtttcctttttaacgttgtgcctagaagcacaggcatccgatagtatgacagggtttttcgaattctggatcaattctagtacggtatcaataacttccttttcagcttcaggatcgttaggttttaatgatagatcaatcggtttttccaaaagagaaccaggaacctttagatctaccaaattcgctggcaaccccaagtagctaggcctttgtgttataaatgttgtcctgatcaacctatcgatttctgaaggggctgtagcaatgtctgtaatcattgatgtagtttctgagatattggcggacatcctgtgaaaaacggtaaaatcaccgttacccaaggtatgatgcaacaacaattgcttagcctgagcggagatagaggggacaccaacaacatgcagtacaccgacgtgttctgcatacgatcctgcaataccattcaaggcagataattcacctacgccaaaagtagttaccagcacagataaacccttgatgcgtgcgtaaccatcggcggcataggcggcgttcagctcatttgcattaccagcccatctcaatccatctacctcgtaaatcttgtccaatagggacaagttgaagtcgcctggtagcccaaaaatggtgttaacattaacttgcttcaatctttcaaataagtattttccaagagtaatttcagacattttgttggcaatatgtttttgctatattactggttttttatttatactgtatataaaagaggactgcaatagcacaagattaagatagaatggcttcaaacagccgccttttatacatattggtaaaagctcgcgaatcgcaccatatcccttatcctgtaatcaaatcgatctaggtgcagatacagatcaattcataaaaagaaattgaagcaccagtttatcactactacactatctttttctttttttttttttttgtcgcagtttcgccctttgttcaatatcacttgataagttgtgggctttttctgtcactcattcggcttaaaaagtattcgttcttttgtgttttatgaaaagggaacgtgatataaaaaaacatcctttggtgtgggacatgggcttttgtttagagaatggttatcactaccgcccccacccttgaaagccacagaaaatgaaaaagtatgtgaataaggtgtgaactctataacattttggccaaatgccacagccgatctgcatattccaatggacatgatgcaacaacaattgatgtcacattctcttacacacttcgattggtccgtacgtagtactttttacataactgactcaggcgtttccttcattgaaatgctcatctattgccaagtacatagaatccacagtgcataggtttatgagatgcttggaagatgtacgatcgcctgcactatattagtatattttttcaggctttacaaaaccagaaagaaattactgactgtaatacttaatttccatgattttaatcgtatggtccgtgaggaaagaggaattttaggtaaaaaaaacctttgtctatcaaaacataaaagaaaagaaaaaaattaaattgaataagtcagctttttagcatgaccacagtaataatagtaatacgatatcagcatgagctgctaaacattaagaatttttgaattgtgttcgctggtaagagaaaatagggtagcattagttgcgagatggaaaattaaaatgtgcgtcataaggtattttcgacgttgaagattaggggttgcaagtccgagaactaaactgccttcacgacgtcaaacttattgtatggtgacaataaaacgaattcaagaagccagagatgatgaggaaccgatgacgaggcacatggggatagaacctccgttatctccattccgcgttgagcagctctcctgcgtgctttcacagagaccctaagccaagaccgcggacggccctctttttcaaggggatcaccggtaaggggccaagcggtgaaattgcgtattgtttcctcctttcaatgatgagtacgtcgccgatccagaagggttattattgtcattgccagtactattcgtatgctgaaaaagtatagttcacttcaccctctggctgcaggctagcctagccgataatgcccccgactccctcaacaggtagaatttgtaaggattcgacgtagcctggacacattgtgcatttatcgtatcccctactgctacacgtataagaagtcgttgctttacctctattccagaactcaatcttgtcgttacttgcccttattaaaaaaatccttctcttgtctcatgccaataagatcaatcagctcagcttcacaaatgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatatcgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaaggcttgggagttccttgggaacctgttgaccttgaaggttatgccaagacttggtccattgcaagtgccaattaaggcagcactatttattcataattattcgtaattatatctccataattatttattcataagttttctttaagtttattctctacatcactatttattacaaattggtcgtatgtacaagcactaatatttcatacttatcgtacttcatacatagcaaatcctgttaggaaaaatatggcagcaaaacagattggctgcctacttttgacacatttttttctaattcggtacttagatcggcatgaactcaacgattatcgcattatacggacaatctgaaaaaaaaaagtagcctaacttatgcagttgtgtgtttataacgttgaattcctaaacctcttgaaggtgtaatataacaagtaacataactaggttttcacaactcgttagtttctattaaaagaggaataaacaaattttattaggactaagaggattatacagagtaccagcagagaaaactttaaattctttctgttataataatatcttaccaaagtttttgttttctatctccacatttttcgtaccatctctttaggtaatcactctgaataacttttattcatatacaccccaatatttttcaagattccacctatctccgttacataaaaggatccatgcacaattttcatggaggaacaatttactaatcagaagaaagtatcacatctacagtcattaatgaacactaaaaggagtgaacagcccacggaatttgccaaaaaacataggtttaaagatacgcttgcattgttcctggtttttttgagttttaaccacttcacttccctatgtttattggtttcctttattgttgctaccaaatgcaaagattttctggcaaattgttttattatacttttcctatcgaaaaaaccttcccgccatatcagtgaagtagcgcacatagatataagtacttccaaagtgaccaatggtagttcaaaccgaaaatctaattcacgattttttggcaattcaaaaaatagcttcgtcattccgatccccgtattaatttgtgaaattttatttgcaatgttactaaagatttacggtggcaattattttgttaagccaataaaaaatctggcaatttctattattgcctcatttttgatcaatgatccaagcgattgcttaagctatgcaacttcatgctcagtattgtatgctgtgtcaactaacacttttcaaagagtgtcacacttctttgacactatacagttatttgatatgtctttacgaggaaccggccaatcaattaaattattcacggtttttcgcaagtattcacagtttttcaaaaagcttttctctctatttttgccaatgcctttcaagatgcttggcaaacattcagacagtatgatttattatctatcctttcacatcctttttttctcatttgcttcaagtttattacaccctcatagacaaacagcggaaaacaagccattgaaaaaaagtttcaattcaactaaaccagatgtagcccgtgttcaaggtctgcaaaagatgagaatttcttcttcttcttccgtttctgccgattcgaacactttagaggaccaaagtcctatgataccgaacgatccaggtggacttagcagcagcaatcaaactatccatccatcccaacaaaataactcgccagttcccctatcatcacacagtaatattttgaaccctgccgcctcttatcctactgatgctacttctagttttccctatttcacttctatggtcaaggaatataagtcatatcagccatcggtaatctctgctgaaggaagcaattctcaagccgttactactactaccagtacaacaacctctcctacaacgttcaacttttctggtgataacactagtttgtcaaatgaaatctctctatctgattcctcgaatggaaattcgaaaaaggattctgatttcttttccccttccaatgacaagtatactaaccaactgtttgaactgaatgttgattttgggaacatgttttcttctagcaaattatcttcagacatatctgttacatcaaacttggaaaattttatccgtcttctattcagaagaaagaatcaacacttgattgcacctctttggtctatggtagttacattaaaaacaacgaattttgaaaaaaaatacttacaagaaacctctgaaaattcactaacaccaacaaattcgaatacttcatacgtcagtaatcaggaaaaacatgacaaagatttggacacgattaatacacattcagtttcatcaagaattagtttcacccatgccggaaagtttaagaagagcgtgtttaacaatttcgaaccttcaaatactatggccctgattgcaaagacaacatctgatgactacaatcttttaaatttagtttccaccaatgaaaatattttcaatagaaatgataatgactacaaagtttgcattattgatattagcacaaactctattacattccatattgaaaatttacatgatggcgaactcattgttttagtaaacggtgttatctggtcagaagtttcatgcgctttaattttagagcatgtaggcgaagaatacgttgtcgttaaaggattagtcccttcttgttcttatgatattcaattcatcaacagactaaatcaccgagatgattatttggtttctgatttaattgtaaggacttgtgggaataacaatgcgattgccggaaaatttgaaaaccttgatttcagcttcccttcatactaccataggaaattcttatctccgttgctaactctgaagcattccgtgctaactacaaacgcaaatttgtccgatgaaaggacaaaattgaaaaagacaaaaaaggaaatcagcaagaagttaagtcttttgagacaagaaattgattattttaaaggcaggatttcacagaacgcaacacatgacgaaaagagcactttaaaagtcgaaaatttgaaggttgccctacagcaaagtgagactgcggtaaataagttagagatgcaattgaaaactctcactgaaaaagagcttgaattagaagaggaatacttgaaaaagaaagatctacacttgaaaaatcaattagagttcagcaagttagaagaaagcttatcgaaagacctgaaaaactcagaagggaggttccaaaaggtcaatcaagaattagttcaactaggctctaaactggacaaattgaacgcgagaaacgagaagttacaaaaggaggtcgatcagaacgcagaagagatagaaaagttcagtactcaatttttgagtaaaagagaaaaggatagatttagaagaaaggagtacaggatacgcgaagccaataaatttgaattgactataaaggggttagagcaagatatcaacagattagaaaatgagaatgaaaatatacatagtctaattggtaatagttactgatggaagattagaaaacaaagatagataagaattcgttttgtagcatcctaaaatttacttctattgaatatatacatgtatttattacttggacgttctactttaaatgtaatcagtcgtttttttctcgatattgtttttttattgtttcctaataacttcatatgttacttttttgccttttgttatttatggaaataatgcaggttaacataagtaaacataaaatatgagaaaaactaagaatgtttgttgatgtattgaacagttcacatcgttgtgtctactattaacactaagttgttgatcaaaacattccctaattaatagctgccccaggacttggaagaccacactactctccatgacatcaaagatacggcccaaataatctgtatcctcgatatgaacttaggaccacatattcggagcttgtccaaaatactcaaatggcagataacaattagatggttccaattcaaatacattacaagctacgaaaactaatattctataatttatactaagttcatggaaagaattgcaatggattgaggtttctaacgaggttatcactaccacaaatatagagagtaagttggtaatatacaacaatagaatataatcaataaccaatctcaacattattgtatcgtattttaacttataattgtgctcatatcaagttttctaggttacaattacgaccaattctcaggttgttttgcaaaattggcgaagagatggaggcctaccacatattatcacgatttgatagggataatctgagtaacgattagttattgacgaatccctttaatatagtttccacacgagaataggcgcctactaaagaattgatgaatctgctggtaatttctaggtttccattattcggtaaaatatacggaatgtattaggggttcttcatgacgatcaaagatccatgaatggggatcggtattttaagtaatagtgctactatttttttcctttttgcattctgtcgttcaatatcctgttacattattaatcttagtttcggattccactgaaatcaataactatatcccatggcttgggccttaattcttgtgtcatatacaataatatgctagtgccgtgaacactagccaatgaagaaatgatcgttttccaacacataccggacgtggctctgatagtgctcgacgatggaaatttcagcatgcatactgatgtatgtcaagataacaactacagtcctatcgtcgtgattatagggaatcgaccgcgccactgctatgacaacggaaagtttatccatggcctgctgattttgatgctgctgtggacacgagaataccaacacctgttcacatcttcatgtggatgaacgtaacgaagtggatatttaggctcggtagcgaatcttttgccgtacctccaaatttatcttgtatcgatttttccgtctagttgaaactgttattatccgcccctccaattttctgtaaagcataggtgcttcttcaaagtatccaatgtatttcttaagcttatcaagaaataacatacttcgaatacgtcccaagttttctgataactttatcatattcttttggctaattggcgatcgtttatataccccagtgattttggttataaatttataatatagttcaaactatccttcctttagaacaactgtaagctttaattttgagcaagcgctaccatttgatatatagcaaactaaccaaaatgctaagacatcttctagtctaaaagtaactctttttctgtgtatctaattcacattgtgaatttgaaaagtacccttatttgtatatatgttggttttgatggtaggtgacctcacttttctttagaaaatttgcaattatagttttagacaatccctttatgtttcatgtgcgtattcattatttttaacaaattcctagttctcaaatctgagtctcttggtaaaaatttgcctccttagcttagtggtagagcgttgcacttgtaatgcaaaggtcgttagttcaattctgacaggtggcataattttatatatctctttttttgcttgttgtacggaagttctgtccatccggtgggcgaccggtatagaattatcgcgccatccatgaaggttggcccagggccgagtaaagatttaggcaggaccggtggtggccactgcctgggaacgtcggcctacggctcgctgcatgccgttgaaaaatttcaattgtaatttggaaaatttaaccaaatgataatttcaatatgtaccactagcactttacgtcaagaatctcaagcaaaccaaagggttttaatcttatacttttccattctattttttaatagaatttaaatcggcagctcttatacttggaaacaggacgttttcattttgcttttttgaaggccagatatttgctttcactttaagaaccaactccaagaaatcttcaaagtttcctttgttagatttatcctctgattgaattattgaaaccacaggtataatcactttggggtagaacattatagttttcatagaaattttacaaaggatctccttcatataccatggctacaagtgttaaaagaaaagcatctgagacttctgaccagaatattgttaaagtgcaaaagaaacattccacacaggacagcacaactgacaacggatccaaagaaaatgatcacagtagtcaagccatcaacgagcgtaccgtgcccgagcaagaaaacgacgaaagcgatacttcacctgaaagtaacgaggtcgctactaacactgctgcgactcgccacaatggaaaggttactgcaacagagtcctatgatattcacatagctagagaaacggctgaattattcaagtctaatattttcaagttacaaattgacgaattactggagcaagtgaagttaaaacaaaaacatgttctgaaagtcgaaaaatttctacacaagttatatgatattctccaggaaattcctgattgggaggaaaagtcattagctgaagtggactccttcttcaaaaacaagattgtttctgttccatttgttgaccccaaacctattcctcaaaatactaattataaattcaattacaagaaaccagacatctccttaattggctcctttgctcttaaagctggaatttatcaacctaacggctcttccattgatactttactaacaatgccaaaggagttgttcgaaaaaaaagatttcttaaatttcaggtgcttacacaagaggagcgtttatttagcatacctaacccaccacctattgatattattgaaaaaagataaattagactcatttttgcaactcgagtattcttattttgataatgatccgcttttaccaattttaagaattagttgttccaaaccaacgggtgattctctttctgattataacttttacaagaccagattctctatcaacttgcttattggtttcccatacaaagtctttgaaccaaaaaaactgttacccaatagaaactgtattagaatagcacaagaaagcaaagggcaatctttaccagccactcctctttacaatttttcagtgttatcttcttcaacacatgaaaactacctgaagtatttatacaagacgaagaaacaaacagaatcttttgttgaagctactgttttaggtagattatggctgcagcaacgtgggttttcatccaatatgtcgcattctggttcattgggtggattcggtacttttgaatttactatcttgatggcagcgttattaaacggtggtggtataaatagtaacaagatattacttcacgggttttcatcataccaattgtttaaaggtgtaataaaatacttagccactatggatttgtgccacgacggccatttacaatttcattctaatccagagaattcctccagttcaccagcttctaaatatattgatgagggtttccaaactccaaccttatttgataagtcaaccaaggtcaatattcttacaaaaatgactgtttcttcttatcaaattttgaaagaatatgccggtgaaacattgagaatgctaaacaacgttgttcaagaccaattctcaaatatttttttgactaatattagccgttttgacaatttgaagtacgatctgtgttacgatgtacagttacctttgggtaagtacaataatttagaaacttctttagctgctacatttgggtcaatggaaagagtaaaatttattactctggagaatttcctcgcccacaagattacaaatgttgcaaggtatgcattgggcgatagaatcaaatatatccaaattgaaatggttggtcaaaagtccgattttccaatcaccaaaagaaaagtgtactctaacacaggaggtaaccatttcaactttgattttgtaagattaaaattgattgttaacccctctgaatgtgacaaattagtcaccaagggccctgctcattctgaaactatgtctacagaagcagccgtttttaagaatttttggggaattaaatcttccttaagaagattcaaggatggctccatcacccattgttgtgtttggtctacatcctcatcagagcccatcatttcctcaattgttaactttgcattgcagaaacatgtttcaaaaaaggcacaaatatcaaatgagactatcaagaagtttcataatttcctaccgttgccaaacttaccctcaagtgctaaaacatcagttttgaacttgagcagctttttcaacttaaagaaatcctttgacgatttatacaaaataattttccaaatgaagttaccgctttctgtaaaatcaatcttaccggttggctctgcatttagatacacttccttatgccaaccagtaccattcgcatactctgatccagatttctttcaagacgtcattttggaatttgaaacctcacctaaatggccagatgaaattacttccttagaaaaggctaaaacagcttttcttctcaaaattcaagaagaattaagcgctaactcttcaacttataggtcgtttttcagcagagatgaatccatcccatacaatttagaaattgtaaccttgaacatcttgacacctgaaggttatggattcaaattcagagttctaactgaacgtgacgaaatcctttatttaagagctatagcgaatgctaggaatgagttgaaaccagaattggagaccacattcctaaaatttactgcaaaatatctggcttccgtaagacatactcgtactttggagaatatatctcattcgtatcaattctactcccctgtggtaagactattcaaaagatggttggacactcatttattactaggtcatataacggacgaattagcagagttgattgccattaaaccttttgttgatcctgcaccatatttcattccaggttctcttgaaaacggtttcctcaaagtgcttaagtttataagtcaatggaactggaaagatgatccattgattttagatctagtaaaaccagaagatgatataagagatacatttgaaacaagtattggagctggctcagagctagactccaaaacgatgaaaaagctttctgaaagattaaccctagcacaatataagggcattcaaatgaacttcacgaacttgaggaacagtgatcccaacggtacacatttgcaattttttgttgcctctaagaacgatccaagcggtattctttattcatcaggtatcccactacccattgctacaaggcttacagcattagctaaagtagccgtgaatcttttacagacacacggtttaaaccagcaaactatcaatcttttattcacgcctggattaaaagattacgattttgtcgttgatttgaggacaccaataggtttgaaatcatcctgtggtatactttcagccacagagttcaagaatataactaacgatcaagccccatcgaactttccagagaatttgaatgatttaagtgaaaaaatggatccaacataccagttagtgaagtatttgaacttgaagtacaagaatagtttgattttatcaagccgcaagtatataggtgtgaatggtggagagaaaggagataaaaatgtcatcacagggctaataaagccactcttcaagggagcccacaaatttagagtaaacttggattgcaacgttaaaccagtggatgatgagaatgtgattttaaataaagaagccatatttcatgagattgctgcattcgggaatgacatggttataaattttgagacagattagaataaacaacaaaatcataacttttagaagtatctgtataatattaaataattaaagcagccggcagtttacataaagaatatttttctttaattcttttttttagatgtggtcctttcggcgatttggcacaagttaacttagtatttttaaaagttttgaatagtactgctgtggcgacgctcagaataaagctaggtaaacgatttgaacgcctcaactagcactatttgatagcattttggctgcagaaaatatacaaagaccttatgagctctgaagaggactatttcgatgagctcgaatatgaccttgccgatgaagttaatgaggaaaaagaagacatacaaactaaaaagctcactacggtaaattgtcaaacagaaaaattcaatccattcgaaattcttccggaaagtatagaattattcaggacgttggcactcatcagtcctgataggttatctctatcagagacagcacagattttaccaaaaattgtcgatttaaaaagaatccttcaacaacaagaaatagatttcattaaactgttaccgttttttaacgaaatcatccccctcatcaagagcaatataaaattaatgcacaattttctaatctcactgtacagtagacgttttccagaactatcttcattgataccatcaccattacaatactcaaaagtgataagcatactggaaaatgaaaattattcaaaaaacgaaagtgatgaactatttttccacttggaaaataaagcaaaattgaccagagagcagatcctcgttttaacaatgtccatgaagacgtctttcaaaaacaaagagccattggacatcaaaacgaggacgcaaattttagaagcaaatagcatattggaaaatttatggaaactacaagaagatataggtcaatacatagcctcaaagatatcaataattgcccctaacgtgtgtttcttggtaggcccggagatagcagcccaattaatagcacatgctggaggggttttggagttcagtcgcattcccagttgcaacattgcgtccattgggaagaataagcacctctcgcatgagttacatacattagagagtggagtacgacaagaaggatatctatttgcttctgacatgattcagaaatttcccgtttctgtccataaacaaatgcttaggatgctttgtgcaaaagtatcactagccgcaagagttgatgctggccagaaaaacggtgatagaaatacagttttagctcataaatggaaagccgaactatcgaagaaagctagaaagctatcagaagccccgagcatttctgaaacgaaggctctacctattccggaggaccaacccaaaaagaaaagagctgggagaaaatttaggaagtacaaggaaaaattcagactatcgcatgtcagacaattacaaaataggatggaatttggcaagcaagaacaaactgttcttgattcctatggtgaagaagttggtttgggtatgtctaatacttctttacaacaagcagtaggagctacatcaggttccagaagatctgctggtaatcaagccaagctaacaaaggtaatgaagcacaggatttctgaggctaatcagcaagctgacgaattcctaatctccttgggtcataatacagagcaaccgaatctgtcgccagagatggttcaaatgcacaagaaacagcatactaacccagaagaagagaccaattggttttccggtcatggttagggctcttctacatacttgataatatttaaaaagatattatatagtagtgaccggcgagagcgttttcgctcataaatttcgtaaaaagccaaacaccacacgctgcaacccagatgccctttttaggaaatgtaattattcaaaaagtaaacaatgacatgtttcattcctcaatctaaatcattcgaagctaccttgatgttgaagccctccgcttgttgtttatttaaaaataaatacaaggaggcaattcgtccaagtaaattattgtaagatagaaaccttgctaaagatagaaactaatataccagaaaaattcaagcaacatctacagtattccttgaaagaaaaattctttaatatgctatcaaaatcagaaaaaaatgtcgacctcttggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaatattactgtgatatgtttgactatgtaattagtagaagacaacgcacgaagcaagttctagaatacctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgtgctttgaaaattttaaacaaaaaactattgtttaagctcaacgagacaaaacacgttttaactgaaagagatatcctaaccacgacaaggtctgaatggttagtaaaacttctgtatgcattccaagacctacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgctgatgttttcaaaagacaagacaaattaacggctatggtagatgactcggcagtatcatcaaaacttgttgggttcactttccgacatagaaatggtaaacagggttccagtggcatcttattcaacggactggaacactcagaccccttttcaaccttttactagcgtaaaaatgaattcttgtcttgcattcgccgcgatataattagctttaacgagcttcatgcaaacttttcaactagcacctatgaacgcttttttcataaatatacatatatatatatatatagttgtgcattacttaggacttcaagcccattgtttaaaatctcagttcaccgtaacggtccatcccatgaccgttttgaactaaacttaagcattcatgttgggagcggcgaaacttggtaatgttttacaggaaaacagcaatgaccactattaatcgaaaatctgcaaaaaatgaaaaggaatgggtgttaacatcaattgttttttcaatgataattacaaattagactggtactacattgctagatgtacaaagaacacaaggtagctctcttggaaggatccataatatataaaaaagggcttatggtttactgatatctttttcacttcaaaaacttatatataaaaataggatgacaaatgcaaagattttagtagctcatataagtgaaagcgatgccgatgaggctatcagaaagatcaagaaagtgaatgaaaaatcagggccctttgatctaataattatattcagtaactcgtatgatgaaaattttgagctgaatactgatgggttacctcaactaatactactatcgtgtgataaggctaacaattcgaaatccaaaaagataaatgaaaatgtaacattgctgcataatatgggtacttataaattagcaaatggaatcactctttcatattttatttatccggatgatactcttcaaggggagaaagaaagcatactggacgaatttggcaaaagtgaggatcaggtagacattctccttacaaaagcatggggcctttcgatctctgagagatgtggaaggttgtctggaagtgaagttgttgatgaattggcgaaaaagttacaagcaaggtaccattttgccttttcagatgaaataaacttttacgaattagagcctttcaagtgggaaagagagcgcttatcgaggttcctcaatattccaaaatatggatctggaaagaaatgggcctatgcatttaatatgccaataggggacaacgaactaaaggatgaacctgaaccacccaacttgatagctaacccgtataatagcgtggttacaaacagcaataaaaggccactagaaacagaaacagagaattcgttcgatggagacaaacaggtacttgctaatagagaaaagaatgaaaataaaaaaattcgaacgattttgccgtcaagttgtcatttctgcttctcaaatccaaacctcgaggaccatatgataatttcaatcggcaaactagtgtatttaaccacagcgaagggacctttaagtgttcctaagggtgatatggatatctcaggccattgcctcattattcccattgagcatattccgaaattagatccaagcaagaacgcagagctgacacagagtattttggcttatgaggctagtcttgtgaagatgaactacataaaatttgacatgtgcacgattgtcttcgaaatacagtctgaacgttctattcatttccacaaacaagttattcccgttccaaaatacctcgttctaaagttctgcagtgccttagatagacaggttcatttcaataacgaaaaattcacaagaaatgctaagctagagttccaatgttacgattcacactcttccaaacaatatgtggatgtaattaacaaccaatccaataattatttacaatttaccgtctacgagactcctgaagcggacccaaaaatatatttggccacatttaatgccagtgagacaatagatctgcagtttggacgacgtgtactagcctttttacttaacttgccacgcagggtgaaatggaattcttcaacctgtttacaaactaagcaacaagagactatagaggctgaaaagtttcaaaaggcctacaggacctatgacatttctctcacagaaaactaaactaaaactatttcatttagaatttcaaatatatccaaatatatgtatatatatgtagaatactaagtcatgctacctctgaacggttaagagacctagcaactcagaggtgatgaattaaaagaaaaaccgggtaaagttcttcgagagaccgcgctgaaaaaatttttttagaagagtcacccatacagcctactggtgttctctgtgtgtgctaccactggctgtcatcgttgttgtatgtccttcagatttatggaattacttagatggtatgaataagtggttaaacacattatctaagacattcacttttcggcttttgaactgtcattataggcgatcattaccactttgtcaaaacttttctctgaagaagtcgttaactcataatcaagtcaggttctttaaaatgagcgatcttgataatttgcctccagttgacccaaagactggtgaggtcatcattaatccgttaaaagaagatggctctccaaagactcctaaggaaattgaaaaagagaagaaaaaggctgaaaaactgttaaagttcgctgccaaacaagctaaaaaaaatgctgctgccaccacaggtgcatctcaaaagaaacctaagaaaaagaaggaagttgagccaatccctgaatttattgacaaaactgttccaggtgagaaaaaaatcttagtatccttggatgatccggctttaaaagcttataatcctgctaacgttgaaagttcttggtatgactggtggatcaagactggtgtttttgaacctgaatttaccgctgatggtaaggttaaaccagaaggtgtattttgcattccagcacctccaccaaacgtcactggtgccttacatattggtcatgctttgactattgctatccaagattctttgatcagatataacagaatgaaaggtaaaactgtcttattcttgccaggtttcgaccatgctggtattgctactcagtccgttgtggagaagcaaatctgggctaaggacagaaagactagacatgactatggaagagaagcttttgttggtaaggtctgggaatggaaagaggaataccatagcagaattaagaaccaaattcaaaaattgggggcttcttatgattggagccgcgaagctttcactttgagtccagaattgaccaagtctgttgaagaagcttttgttagactacatgatgaaggtgttatctatcgtgcgtccagattagttaattggtctgttaaattgaataccgctatctctaatttggaagtcgaaaataaggacgttaaaagtagaacacttttatcagtcccaggctatgatgaaaaggttgaatttggtgttttaacatcatttgcttatccagttatcggtagcgatgaaaaactgatcattgctacaactagacctgaaactatatttggtgatactgccgttgcagttcatcctgatgatgaccgttacaaacacttgcatggtaagttcatccaacatcctttcttaccaagaaaaattccaattatcaccgacaaggaagctgttgacatggaattcggtactggtgccgttaagatcactccagcccatgaccaaaacgattacaataccggtaagcgtcacaatttggaattcatcaatattttgactgacgatggtttattaaacgaggagtgtggtccagagtggcaaggcatgaaaaggtttgatgccagaaagaaggtcattgagcagctgaaggaaaagaacctatacgttggccaagaagataatgaaatgaccattccaacttgttccagatctggtgacattattgaacctttattgaaacctcaatggtgggtttctcaaagtgaaatggccaaagatgctattaaggttgttaaggatggtcatattaccatcacccccaaatcttctgaggctgaatatttccattggttgggtaacatccaagattggtgtatttccagacaattatggtggggtcatcgttgtccagtttactttattaacatcgaaggcgaagaacacgatagaattgatggtgactattgggttgctggtaggagcatggaggaagctgaaaagaaggctgctgccaaataccctaattccaaatttactctggaacaagatgaagatgttttagacacctggttctcgtccggtttgtggcctttctccactttgggttggccagaaaagactaaagacatggaaactttttacccattttctatgttggaaactggttgggatattcttttcttctgggttactagaatgattctattgggcttaaaattgaccggttcagttccattcaaggaagttttctgccactctttagtccgtgacgctcaaggtcgtaagatgtctaaatctttaggtaatgttattgacccactagacgttattactggtattaagttggatgatttgcatgcaaaattattacaaggtaacttagatccaagagaagttgaaaaagctaagatcggtcaaaaggaatcctaccctaacggtattcctcaatgtggtaccgatgctatgaggtttgcattatgtgcttataccactggtggtcgtgatattaacttagatatcttacgtgtcgaaggttacagaaagttctgtaacaaaatctaccaagctaccaagtttgcattgatgagactcggtgacgattatcaaccacctgccactgaaggtctatcaggtaacgaatccttggttgaaaaatggatcttgcacaagctgactgaaacctcgaaaattgtcaatgaagctctagataaacgtgacttcttgacgtccactagcagtatttatgaattctggtatttgatttgtgatgtttacatcgagaactctaaatacttgattcaagaaggctctgctattgaaaagaagtccgcaaaggatacattgtatatcttgctggacaacgctttgaaactaatccacccattcatgccattcatttctgaagaaatgtggcaaagacttccaaagcgttccactgagaaggctgcctcaattgtaaaagcttcttacccagtttacgtatctgagtacgatgatgtcaaatcggccaatgcttacgacttggtcttgaacattaccaaagaagctcgttccttgttatctgagtacaatattttgaagaatggtaaggttttcgttgaatctaaccacgaggaatacttcaaaactgctgaagatcagaaagattctattgtctcgttgatcaaggccatcgacgaagtcactgttgttcgtgatgcttccgaaattccagaaggttgtgtattgcaatctgttaacccagaagtcaatgtacatcttctcgtcaagggacacgttgatattgatgctgaaattgcgaaagttcaaaagaaacttgaaaaggctaaaaaatccaagaacggtattgaacaaaccattaacagtaaggattacgaaacaaaggctaatgcacaagccaaggaagccaacaaaagcaagctggataacactgttgccgaaatcgaaggtttggaagctactattgaaaacttgaagcgtttgaaattgtagattgaaggtagataaaaattaatgtaatatatatatatatatatgctatgtatatgtaacaacgaaaatgttaagaactttagaacattaaataataattatttctaaatataagaggtagtcttcggcatacgacatagcatgttgtggtatattataatctataatggctatacaactagacgaggtgatatattgtcctgtattattcttcttatatttgtgacaagttcttgacacttttgctcacccagctccagtaaactgaacaattgatcttcattaaaatcaccattgctgtctaacaataaaacgtttttcacgactttaccgccattgacgaactccaaagctaaagtgtggacagagagcgaaatcttcaattgctcggcagtgggatcgacaatgatatcactagtgtctttgattattgcaatagggatgcttgcgcacatactatttaaggcaattcctgcatcaactaaagccaaaaatgccgcatttatacaacaacttagctctctcagggagaattcggcttcatcttcaccagattccagaatttgacaagttatctggcagagctgtcttgggtaacaatgacgagtgatgagtggggtcagaactgcccgtaatttatcttcgagtaccttctctcttgttgtggccacccctttcgcgggacgtacaataatttctaatgctaattgtgtaggcagttcttgtcttgcttttggttcaatagggcctgttacagaacaaataaccttggtgtcttgtgatacgaattcagatgaaccatctacatgatctaatatccctatttctgcttggacgctcattttttttttttttcagcagaatctaatctattcttggtattgggctccttgttattaccatatatgcagagattttttatgcatcttaactggttcatctaacaaattttctactcttttttccacaatccgatgcgcttaaaaggaaaaaaaaaagtagtaaaaagaaaaagaaaggtacataatagtctttatgaagaaaaggcgctattttgtcacctttaacttggcatagtctggagctttatataaaccattcaaagtacataaatgttgatatgttcaaagaggaggactcgttaagaaaagggcaaaatgtggccgcgtggaaaactttgttggctggcgccgtatccgggctgcttgcccgtagcataactgctcccatggataccattaagatcagattgcaattgacccctgcaaatgggctgaagcccttcggaagtcaggtcatggaggtggccagaagcatgataaagaacgaaggcatccgggccttttggaagggtaacatacccggttctttgctatacgttacctatggctcagcgcagtttagttcatactccctttttaatagatatttaactccatttggactagaggcgcgcttacatagtcttgttgtcggagcctttgctggcataaccagttccatcgtttcctacccgttcgatgttttacggacccgactagttgccaacaaccagatgcactcaatgagcattacgagagaagtgcgtgatatctggaaactagaaggtctccccggatttttcaagggctccatcgcgtcaatgacaaccataactctaaccgcatctataatgttcggaacatacgaaacaatcaggatatactgtgacgaaaacgaaaaaacgaccgccgcgcataaaaaatgggaactggctactttaaatcacagcgccggtaccattggcggcgtcattgctaagatcattactttccccctcgaaacgatccgtaggcgaatgcagttcatgaattcgaagcatctggaaaagttctcccgtcattcgtctgtatacggttcttataaagggtacggattcgcaagaatcggtttacagattttgaaacaagaaggtgtgagttcgctttacagaggtattctggtggccctttccaagaccatacccaccacttttgtgagtttctgggggtatgaaactgccatccattatttgcggatgtactaaagtttccaatcttttttgtcacatgtacacactcatatacatatacgaaatcatcatatcttatattcttcactgacaaagatcggtagccgcccggttttccattccgattacggcctgactcagtcgcgccgtcttcctctaataacaaaatatcgaaaaaaaaagaggaatctcgttgctagcgatctgacgccaaccctttttccggtttttcttagttgcctgctgccccgcaccggtttttcttcttttttttatctttttttccgctcagtcagcggggaagggagagaaggaaacaatgaatcggatcttccgatggaaccagcgtcagggaccactacatctgcttgttgtttcaacacaacttacatctgcgcaagcacacggactaggagtaacaagaagtagtaaaattgaagaaagcaaggactgctgcaatctctgcacccttgtggtagccacccttcttagatgtggcatacttactactttttttttttttttttttttttttcgccttttcttattttcttggctccttaatagccaagaaatgagaaacgtgggagatgttcaacctcgcctgatcctaccaaaaaaaaaaatcgcaaaaataagcgggaaaaaatgtcagattctaagtttcaaacctccggagatgattcatcatcaccatcaccgccgatttgttggattgcgtgtttacgatccatcatttttcttgtaagcgtttagctttctgtcatctctttatcttttttcctatttttttttttcactagtttttgcactgaataacacctccccttactcataaatgtgctagctgaatccatatttcctagtcttgcattctctttcccttcaaacagcgctgcccttcttcatcttcattgtcgaaaattaccattcttctcctatcttgaaatctaaaaataacgctactacagaaagcttttttcacaggaactagggcgaagcgtacaagaataaggaaagacagcgtagttacaaactaaactatctatactataacgaccgaaaatttctgttttttaacacctcttctaccaaacacaacgagagtgcattagaaataggacaaaactgggctcaaactaatgtctgattactttagttccagaccttcgcaaacgctcacgccgatgggcaataggccatctggaggtggtggcggcgatgacgcctcctccatccactcgaagagctcgcagtacttgatggacatcttacctgattcgatgaccttgaacgaaagcgtttcctccacagtggcaaacaatcaggcaaaggagtttattttgcctgaaacagatgagagatctccctacttcataaacgtccctataccaaaggctcagccaacctctactacggaaacgaagaagccccttgcaggtgatgaagctatcgatgggcagtttgttaaggagtatcccaccgacatccttgtagacaggttttataaatggaaaaaaattctgaaagggttagtgatttacttgagggaagtcgcgtatgcgcaagaacagttcgcacggatcaattaccaactgaaaggatctgtgaaatttccatttttgactgatattgatgaaaccacaaataccattacggatccattcacaacggctcctagaggccctaagaaagcgcagcctgcgcagaagaaagttggcctgactgacagcgaacaatttcagatgcaaatgcaacaggaacagcaggaaaatgcagtgcaggctcccacagatgaaagtaaaatgagtttggcgcctcatgaatacaagcctgtccagaccacagagtcggacaatacatctgccgcatccggttttgttaagttcggttcaggctcgattcaagacatccaggttattttgaagaagtaccatctttcgttggctaaccagcaatttaagatctctaaagagattacgtccaccgtcattcctaaattggaggaattgagaaaagatttaagatataaaattacggaaattaaggaccttcatggtgatttcaaaacaaacatcggagcacatattcagctaacaagtcaactattgaaaaaatacatcgcagctgtaaaattcatgaacgcgcatggcattggcaacgatagagcatctcctaataataagaagccacataagttggatccaaaacatgacccatatcttttgaaactgcaactagacttacaactcaaacgtcaagttgctgaagaaacttacttgcaagaagcgttcatcaatttacagagttcaggtttgcaattagaaaaaattatatacaccaaaatccagcatgctttgttgcgttattctgctttaattgactccgaagctcgtctaatgatcaaaaatatgtgccaagaactacaacatggtataatatcaaagcctcctgcatttgaatgggataattttgtcacacagcatccgtcctgtctactcaattggaaatccaacgatcctataccaccacgaagaaaagcttccgacgttatttatcctcacatgaaatccccactggccaagtgtattaaggcaggttattttttgaagaaatcggaattgttgcccacttaccaccaaggatattttgttctaacatcaaactatattcatgaattccagagtagcgatttttataacctatcttcttctacccctaactccacgaagtcttcagcttattcttcttccgtttccattgcaaacacttatgccaatgctaataatgccaaagctaacaatcatcatcgccaggctagtgatgtacataacagcagtacgacaactggtggtacagctggtgcaaatggtattcgcggtattcgcaaaaagagctatttggcaccgattatgagtattccgctaaatgattgtaccttaaaggatgcatcttctaccaaatttgttcttgtaggtaaacccactctcaatgaaaacgctgatgttagaaaatctagctctagcacttatttatctggctcttcacaagcgtctttaccaaaatatggccacgagactgcaaaaatattttcaaaagccccattccacaagtttttgaagggaagtaagcccaaaaataagaatacgaaatcaagtgaactggaccaattttacgctgcagctcaaaaggaatcgaacaattatgtgacttggaccttcaaaatagtatctccagagccttctgaagaggaattgaaacattttaaacgttgggtccaagatttgaaaaatttaacgagcttcaatgacactaaagatagaattaagtttatcgaagaccgtgtgatgaaatcacaccgattcaaggcgggacatatgtcgagaaacagcgtgaacataggttcccatacaccttgtttaacagatagcacattcacattacaagacggtactacgacatccgtcaacctaaagggcagggcggagaaacctcagtatattcatattcagaacaattcactagcagattttgatggaaatggttttagatccaaggttaatacacctgctattgacgattatggcaatttgattacggtggaaagaagacctgcacaatctccgcaccaatactctgactacatggccacttcaggtaacacaactccttcttattcatcgggctcaagacctcaaagcatgtataatgggtataacccggctgtatcaataacgagtaatgggatgatgctccaacaatcaacagcaaataataatactaatccaacaactaatttgcgccaccaaagaaatatttcacaaacaagttccctacctggattttcatacacatccccatctctaccagtgaattctccaggtagctctaattcagaatccagctcaggcggttattttgccattccgcttcatgggaacaacaacaacaataattacacccagagaaactctgaaggctctagcccatgttataatgacgaccaaatacgacaacaacagcaacctttacaaatgcaacctttatcaagaacttcaagttcaagtgtaaatgtcacagcgatgagaagtacatctgcaggtaattcaattacagcgaacgctcccgttgtacctaaggtgatggtcaataatcaaaatgttaaaactgttgctgccgatcagtctgctacagcaccttcttcacctaccatgaattcgtctgtcacaacgatcaaccgcgaatcaccataccaaaccttaaagaaaacgaacagcacaggtaatgttccttgtttgactgctgaaaagactcatgcgcaccctgctttctataaacggggcaataatagcgcccaaaatttgactacctctagttcaacagcttctagggtgcatcctatccgaaagcacaagaaaaacgtatcatttagttctttgaatagtttaatgttttcaaaaaagggtgcaaatcacggtggtaatctaatgactaaccaatttatgagtggtggaattcaagaagatgatggtgattcaactaataatgatactataaagctaaaccagtcgatttattcttaattgttacgccttaacttttgttctcttttgagaaacagcctgtatggttcgccgtttattttctaagcaccgctttttattcatatttttataatgcaactcctatagaatatagatgtttcgtgtttttaattcctgctatgactttgtgtcaatggtatgtgaactaacaactgtgtggtagtttgtgatggtacgtaaaggtgttcgtgattatataagcaatcttaaaatatttgtatcgcaccatggggtgcctaataatgaaatgaaaattactattatgaactatactaaaaagatgaaacttttttatcaatcccaggttcttttacttattatttttggatattagaacaaaatcggatttcccatgctttttctcaatgtctatatgaaatcttttcgaaacagccagtacatgtaacaattatgatacgaacttgattggtaacccataaataacaggagctgcgccgttcaagtaacgtagatggcatacacctctagatttagagacggcgtatgaaacagataggctattaccattcaaatcgtcagtattacagcgaaatcccatcttttcaaaaagttcctcgctaaatttatcaatatctttgtcagttacatcccacagattacctagtaccatagggcatcctcccagcaaataagtatagattgttccagtaggttctaacttgccgtaatacttcatcgctgctgaagagcagcccagtaaaaagctgggggcaattttggtgcatttcttaatctccttactccttacatattgttcacctccgccatgccctatataaacgaataagttagaattttgcagcattttcaaaagtgtttcctcttccggcttctcgttcatcactaattgagaggaaggttttgcatcgattattttttggaacatacccttgaatttagattcagtcctggacaaatctccgttcggatttaatatcatactaatgttgtcctcaatagtaacttgaaggggtagttggtagtggaaacgcgataaaagtttattcagacaaacataggacggaacacgtgtgatagacaaatctttcaaaaatgaaagacactcccaagggaataaatggcatgaactgctaacgactaaaaatgtatgaaatatactattagttgtcatagttgccctacatttctttatttgctcttctaactgcacgtgaagcatgctgaaatcaatttcgtcgtaagcattttcttctccatggaagagaagaatatcaagaacaaagtatatcaggtcttccatcttcgaaagaaaatcgatttcttgcggattaagtttcaaaaacaattcgattacccaatcttcaacttttataaacattgccggattgccatagagttttctggaaggaagattttgatgcagaatttcgtaaaatttatctttaaatttttcaaataacgagttgtcgactacttcagggctaaaaaacccttgaacgccattgaaccaactattttcaatgttattcaacaattgttgcattcttttatccaaatcatatcttgtggtccaccaagattttctttcttctcttgttttaatcttgttggtaacttccactgacgtcgtttggttgctttcattgatgatagaaagtagtttttttgtagcctccggaaatgagagatgaacttcgtcgaggtctcttgaattagatcgtattagcggtagccttaaatgcgtccttctcttacgtcgcggttctaatttggatagaagtaaatttccagttatgggacagaagtcaatagttataacattaatattaaggttgctctccattaagtccttctgggcggcagatactctaataatctctgtagttgtggatatattgttcgaagctattagtgatgaaacgcgaaattctcggtaatttttattatcaatattattcaataccttatcgaataacaaaggcatatgtcttggcaagtcagttagcgaaaaattagttatcaaactactctcagcattatggatactagttatgtttgaaaggatagtcagagttaatgaagaaagggaggaaattttggacagttcgtgattatctaatgtgtctagtttcaaactcttcaaaagttctttcatctgttttaatttaccaatagcagcaattctatcaaatttctgtcttatattcttacctctaggcgtcatgctcgacgatcttggtgaatcgcaaagcttcaatcctgtactatgcttggaaggagtttttaaaatgttgttgggcatcatactaggaataacaggcaaagaagagggaatcccaagggtagattcaaacatacctttgaagaaaggatcttcctccaattggctcattactttttgccacatattgtgtactctattgattacatttttgggcatatattcggacagacaagtgctgtcgtcaatatccttacccaagttaagcttccacaaattaggtaaaaatgttttttctagctggtcaccgaaatataggaccaacgattgctctaactttacaaattccttattatcatacagaaacattgtcaaacttgtaatgtctgcctcagcatcaagataatcaaatgccttattggcttttcccaaagttatattttgaagacaggtttgctctgtaatcatatagtatctgtgaagaaaatgcagacatctgtagacgataataggttcctctaagtcagaaataattctagacagttctttactgtagaactcacagtctctggcagaaccaatgcgtatatgtattttaatgagttggaaaaaactaaacgatagactttttagtaatgctagcctggatccttgtgacaatttgttcttctttttgagcaacgataatgctaaattttgtgcttttctacaatcaattactgcggatataacattaccagctttaatatttaatttcgcgctttcattaaaaatttttatgttcaaaagtatgactttgatgtaaagtgacatgggtaggttgtggtcgttattgatatcaaataattcaggcttcatagcaggcagtgtttttccaaaatatatttgaaacgctgtcaagtcagagtcccacaagtggacatttattaaagaacttgcatgtaataacgcctgctctattttcgccgatgataaattcattgttttttgtagttgattcttcatcatgagggcatcatcaatcatatataagctcagataagcctctagcaaataattgtcggcataaggcacaatactggagtaatacttttcttttgatttaatacagagtgaaagttcaatggataatttatcaaaattattaaagttcaagtagcacaatagcattttaacgaagtccatttcaaatgacgatattctctcggccttttcatctgatttttgtagccatttgtttatgtacagcttagttattttcgatagattcgttgtcaggtgtttactcatgtccaggttcaataggtacactattcgtattaatagctcatatttgttgagcaagtgtaatttatcaaacttattatttagctctaaaggatccaaatcaaagatacccctcagtgagcaaaatatcattctgcttagttgtgaccaattttcggaaggaatgttttcgatagatgaatttccatacagtactgaaagcataatttctgaactgtttgaaaactcgatgaattttgtgatttttaggcgtgtaaagcaatgaatgaatgcattttggcaaaagtcaaaaacaaatgataacgtatcatttcgtagcatgcaatatacattgaacaaacaggaaaagatttcaatttttttctgggcactctgagcactagatataaatttttcaaatttcagtatagtacgatgagatgtttttgaatcattactgattaaaacatttgtgatttccaaattagcagtctttaacaaaaacgaatgactcttaaataaaacagaagcattgaaaaggacactgataatatttgacagtcgtttaggctctttataatcgatacaaatttctgataaaactcccagaagttcggataataatgccgccgcagattcgtcattaatggatttaatatttgagttgatataaataacagtacaatcaaactgcctcaatatatccttatttttaggtaatccctctaggcgaatagtagaccaaagacagactaaacattttaacgttgcggatatatgtttccccttattttgtagaaaattcgttgcattttcgagtattacgttcaaatcatcaacagatatacaggaccagagaagacggttttcactcatgttgcagtattcattgaattcttttttactttttatcgctctttgtacctcagtagtttcttcgtaacttaaaatgtctagaagcattattttatccaatccatcgtacagcatggaataggataagtaaaatgaatttaaatatattttattaggtcccatctccaaataatttttatgaagaaggtttttgctaaaacactcgatggtaatgttgctaatgaactttttaaaaggtaatttgaactgtttgatatattgtagaaattttagcccgaatagaactttgcaactcgtcgtgacagaaaaaaagctcagcacgatttttgtgagagcgtgagctttgaggttagggtccttcaaaagatatcttttatcatgggaaaatagttctaatatatgcggtaagtattcgcctactagctttcttttcagtataatctgcagcgctaatattttcagatttgaaagatagtagtcgttccacgtactgaagtctgctagaagaatgtttttcagactatgagcttgaaataaattcgtttcattgaaaagaaaaataatttcagaggaggccaatcctaatgcattattatttattagtttaacaattatcatcaaatgttgtttaacagtggagtttatatggccccacatgtgatggctcttcaataggctatatattgaatttaatgaatggtcaacagtggtaatatcctcggtggctaagtctatgttattgcttgcaatttttgtaaagtcacgtattatgttattatgcattgctagtatgccaatagaactggatgaggcgtctcccgacaacaccgaggtcagtggtctagtttggccactatgatgtactttcgaaagcgtgtcgtttaaaaggtaggacttgctagtcatcggagtattcggactaatctcattcagcggttcctcctgttttaccatcattccttaatttataagcacttcgtgcctaggttaaattattactaggttagcctcaaaaatgttgggtttaggtcaactttttactatgctcgcagttagaaggaaaagaaaaatatgctatagccagatgctcctgtgaaacgtgtcctaactaaaataattcggatgtttctgatgatagagtgtctatattcctccaaaaggaatttaactaattgtgtaagcttctcgcttcaaatgcgcaatgttacgtggatgggctttgtatccatgttcttgtttttgtttgtttacctcttttctgtaaagacccgtgaagtttgaaaagaaagaaaataaaaacaaacaccaagagatgcagacaataagtacttgtggacaggttgccgctaatagaacgtgaatcgagctactttatacgcatttaattcctcatgaaatggttttagaaacgctgaaacaagggcttgacagcagtcaaatacatgaagctttaatacaactagattcctatcctcgcgaaccggtggatctagatgcctcgatggttctcataaaattcgtaattccagtttatccatcactaccagaaagatcgaaggtgatattgagacggctagcttctaaatcgtttacatttttatgccaaattgtcaccttctcaaggacaataagtggccgcgatggactgcaagagatacgcatataccaagaaattttagaagacatcatcagttttaaaccgggatgtttgactttttatttaaaggcaagcactactagcaaagcagaccgtgatagcattaaggcccttttctttgggagcaagttatttaatgtgttggccaaccgaattgatatggcgaaatatttgggataccttcggcttcagtggaaatttctacttgagaataatgaaacagatccacctgggtttttaggggaatggttagtttcatcatttttgcttaacccagtgctagcggcagatatgttattaggcgaattatttttattgaaagagtcgtatttctcttcttttcagaaaatcatatctgctagtagtctgatagatcaaaagaggctgattgctaagtttttattaccatatattcaagttatcgtgactttagaaaatttgaacgatgttaggaaaattctgcggcggtttgatctcgataaaatcataagtctgtccgtattatttgaaatacagtcgctgccattgaaggaagtgatagtacgtctgatgagcaaccactcttctacgaagtttgttagcgctttggtaagtaaatttgctgattttacagatgaggaagtagacacaaagacatgtgaattgcttgtactctttgcagtgcacaatctcaatcattcccagagagaggaaatagcacacgatgagcggtttttgaatggcgtgaccaaacatttaggtagcaatgaacgtgaggcaagggagcgtgcgatgtttattgccaagcttttatcaggcggtcatctgaagtacgaaagtgattttaaaatcaatataccgaatgtcaaattcgaaagcaatagcgatgataaaatcattgatttccaatctttaaaaaatccatccatatgcaatacccaaactgatgtgggtaaggataagattactgaggtctcgggtcatgttcaaagccttacattggactgcagtgatagcgatgatgaagatgataacgatgagcgggagattgttaaacgaattgtatttttaaaagatttaatgaaagaatacgaaaaaactggagaatctcgaaaagctccattgataccacttctgaagcaaacagtgaaattgatacggcaaaaggcggattttcagttagaggttggctattatgcacaaggtattctgtcaagcattgtgtgcttgaataatgaatttgatgaaccacttttcgagcagtggagaataaacgctctagcaagcatactggtcgtccttccagagaaggtaagtggcgctataaatattctattcaattcagaactgtcgttacagcaaaggatgtcactattgtcggctctgggtctttctgcaagagagttgagagggcttgatgatcctactattgtcaagcccaagtttgattttccaacaaatcgtttaccgtgggatgatcaaagccatcataatagtaggcttgttgaagttcaagagtcaacaagtatgataaagaagacgaaaacagtatggaaatctagaaaactaggcaaggatcgagaaaaaggaacgcaaaaccgctttagaaaatatgctggtctattcttctatccgctagcacacggttggcttaatggaattgatgtaggcacgtacaatcagctttttaagtcgcattatttaacaacactgcgtatcatatactcttgcgctaacccggtccacgattttgaatctatgacggagttgatgaatcatataattagttcagccatagaggaaggaattcctctcaataaaggttagtagcatagttatttgtaccaatcttatgatacatatttgaataaatttagtgcgttctctgtcagcgtcattactatttaatgcacagcatattatttcagaaggtcggccgactcctgcaactgggaaaaagaacttcaataagaaaaggcctgaacaaatctgtttggtaaggcccaacaacatttaagaatttgtacattttgaaagcactgatccatcaattaaagcaccgaacaacctcagagttgatacaattattagttaaaggataggatatgtcattttttgattccttacgtcaaaaggcaccctttttggataaactggcagacagtttcactccaacattaaccagagatgagaaattcagattaaaatataaacttccagctaatgaaaacattttggaggatacgaatgcagaagtttcatttgcaacttccattaaagatggaaaagggcattctgatagagtgaacaataaagggagaaaaactgcttatgtgtattccgggagattgtttttaacaccccactttctggtatttcgagatgcatttgatcattcatcgtgcgtactaatactgaatatttctaccattaaacgtgtagagaggtcgccatccgaatcatatgaatttgctcttctagtaactttgtacacaggagcaaaggttctgattcaatttatcggtatacgttatagatcggagcaattttgtgacaaattgaaactaaatttgaaagaaaatattcctaatgccaaaactttacctgcttttctagaaacctcatattcggagttcttaattgctaaaaatattctaggtaaaaaggacataactgtacccagggcaggtctaggacaacatttcaaatatcccggtaatcctactatggtaaaagaaaaggctaaattgaggttatggttcgattatttcagagagaatggaaggaatttggcagttgtgcaaactcctatgttccgaaagttaatcagaatcggtgttccaaatcgaatgagaggtgaaatttgggaactatgttcaggtgcaatgtatatgcgttatgcaaattctggggagtacgaaaggatattaaacgagaatgctggtaaaacatcgcaagctatcgacgaaattgaaaaggatttgaagagatcgctgcccgaatactcagcataccagactgaagaaggtattcaaaggttgagaaatgttctgacagcttattcgtggaagaaccctgatgttggatattgccaggccatgaatatagttgttgcaggatttttaatctttatgtctgaagagcaggctttttggtgcttgtgtaatctatgtgacatctatgttccaggttattactcaaagacgatgtacggtacattgttagaccaaagagtgttcgagtcttttgtagaggacagaatgccggttctttgggaatacattttacagcatgatattcaactatctgtggtgtctttaccttggtttttgtctttgtttttcacttcaatgcctctagaatatgctgttagaataatggatattttttttatgaacggttctattactctatttcaggtggcattggcagttctgaagataaatgcagatgatatcttacaagcggatgatgatggaatgttcattgccataattaagcactatttccaaactctgggacaaagtgctcacccagattcaagcgatataaaatatagacaaatcacgaaatttcaagagctgttagttacggctttcaaagagtttagtgtcatcagcgaggaaatggcaatgcatgcaagacacaaatatgagaaaggtatttttcaaaacattgagactttcatgaaaagaacgcaactgcgccatatgccaaaaactttcaacctgtccagtgatgacttgtccaatatctatgacatgttttaccaaagtatagaaacctacaaaattagtatgggaacgggatcatctaatatgggtttcgaagtattcattcagttcttgagtaaattctgtgactcctgtagaccgtgtgaaaaggacaaagatccagctttccggaaacaaaaaaggaattttctgcaaaggttatttgataactgggattctgctcatatcggcgagttgacattgaacgatgtggtaacaggcttggataaactggtaactgttgatcttttacaagctataaactatttcttctctttatatgatacagatggtgatggtgaattgcatagagaagaagtgctacagttgtcggaagggctgctactgctaacggaaccttggaagagcggtagatatgtagatctgttaactaaaaagcgcattgaagatgatattgctgaaaacatcatcaaggaaagcggtggagagatagccaccatgaaccaaatcgagttaccaactggggttactattgatgaggaaaaatataaagttgaacaagcagaaagatacctaaaagctgcaagcaatttcctacaaagatcttttgaatatgctaaagcagttgatctcgcggaggaggtaaacttgattgacttgtctgatgatgaaggcgaagaaaagcgaacggtaaaacaaaaacaactggaaagcataaaggcaaatgcagccctagatcccacccatccaaaagtaatagatttgccaacatttagaatgatcatcctcgcagatgaaacttacgagcttttcttttctaatactttacgatcatctgttcacgtcgacgaacatatcaacattgataacaaaaataaagtcctcagaagtatgtttgacggtatattggcagacggcaaaagagttgctgagcaagttcgtcgtcgtgtcgattcggtggcaactaggagcagcattgcttccgtagagagtgcgccaacagccgctgcaagttcaataactaccaaagaagaaaagtacgatgatctagatgatttcacgtcagagcatcaacccgagaatgaagagttattacaaagttcctggtttgagatcgacgatgccaatgaaactagcactaaagccatacaagaaaggtcttttgagcctttgtcggcaaattcctcggaagagaagtccaaccttattgaatttgaagcatgaaatcgtgcttatcaattttatgtcaccctaaaacatctgtacgtgtttatatagatatttaaagcaatatttgccaggatttggtgaagatccctcatataactctcataaatgcggattttcagagcgaaaaaagcctaaattcttgtctggaagtataattggcggtgaaatagaaaaggtggcaatcacgactgaaaagggtacagctttcgcaactgacatatacagacagtgaaaagtaataaattgcccaagtgtgaacatgccaggtgtaagctctgttatactcggtcttcgacctgctacaagaatttttttccgcagtaatatttcggtttcaccttcgaggacttttgtatcatatattggaagatcccagagcacgtcgatactcaaaaatgctcccaacttagaggacaatgtcacaaatcttcagaaaattataccgaaacggttcttttctcaaacatcaattttgaaatcaaggtggaagcctatattcaatgaagaaactactaatcgatacgtacgtttgaacaggtttcagcagtaccagcagcagagaagcggcggcaattctctgggctctatgactattttggggctctctttaatggcaggaatatattttggctccccttatttgttcgagcacgttccaccctttacgtattttaagacgcatccaaagaatctggtatacgcgttattaggcatcaatgttgccgtatttggactatggcagctacccaaatgctggaggtttctacagaagtacatgttgctgcaaaaggattacgtaactagcaaaatttcgataatcggaagtgcgttttcacatcaagaattttggcacttaggtatgaacatgctagcgttgtggtcctttggtacttcactcgcaacaatgttgggagcatccaattttttctccttatatatgaatagtgccattgcaggttctttgttttcgttatggtatccaaaactggcacgcctagccattgtcggacctagcttgggtgccagtggagcgctatttggggttttaggatgtttttcatatctattcccacacgctaaaattttgctgtttgttttcccagtcccaggtggggcttgggtagcattcttggcttcagtggcatggaatgcagctggttgtgctttaagatgggggtcatttgattacgctgcgcatttaggtggctctatgatgggggtcttgtacggatggtatataagtaaagctgtagagaaacaaaggcagcgtcgccttcaggctgctggtaggtggttttaatcacttaaaaaaaaagacacattctcattcgaaatattgtaaatactgctatgtcttctatgtatttaatcttatttatgcatttgaaaaatatttcagcctcatcgtggtggtacatgtacaagaaaattcataggtaaaagaatatatagaatagagcgtatgtgttacttttctaagtcttacttcctgtttttgagtagtccctctttgacaacaaaatatgcatttttggattccgcggcaagtccagttgctttccaagatccgctaacttctcctaactcagcatcctgcttttggtggctgatgccttcaagtagcgttgtgtagttcagctgtttcgtatttctttgcaccaaccgagcatcatattccttggtgtgcttttcaccttcgacaggtatgttatggagtttgttgatgaatgataattgcttggcaagtcgcatttgaatttctttaatatctgctccttccaagggaagacctgataaccgcaacaatttttttacagcttcagcagacggtggctctagtttttcctctttaatgtttatgcctaaatattcgtggacggaccatacaggtcttgataaataatcccttatttgattcatattgtcaaattttttaccaatctttgcccctcccgtagatacgaaccgatgacttccatcatggcataatccacccactgtatgtgttctgcatagacgccatgttttgtacatcgttctagcactatgggtaagtgcaaatagttcgatctaaaagcctaaatgctagtcactattacctccttgatgttatatttacagaataatgacatgtcgtctgtggtgactattattattgcctgaaaaaattaaagaaaattttttgcgatgagatgagatgagaaaaaatgaaaaattttggaaggttaattagagatgtgtagtaaatcctgctggtggaatacattttattcctgtagaaaatagtatagtaacagcggtatcctacttatacaatgagaatcaagaagaaaaacaccagaggtaacgcaagaaactttataaccagatctcaagctgtgagaaaattacaggtttctcttgctgatttcagaagattatgtatattcaaaggtatctatcctagagagccaagaaataaaaagaaggcaaacaagggctctactgcaccaactactttttactatgctaaggatattcaatatctaatgcatgagcccgttttggctaaatttagagaacacaagacttttgctaggaaactaacaagggctttgggtaggggagaagtctcttctgctaaaaggttagaggaaaacagagatagctatactttagaccatattatcaaggagcgttatccaagtttcccagatgctataagggatattgatgatgctttgaatatgttatttcttttctctaatttgccctctaccaaccaggtttcctcgaaaattatcaatgatgctcagaaaatctgtaatcaatggttagcctatgttgccaaggaacgcttggttcgtaaagtgtttgtatccattaaaggtgtttattatcaagccaatattaagggtgaagaagttagatggttagttccattcaagtttccagaaaacatccccagtgacgttgatttcagaattatgttgaccttcttagaattctactcgactctattgcatttcgtcctatataagttatacaccgatagtgggttgatttatccgccaaaattggatcttaaaaaggataaaatcataagtggtttgtcatcatatattctagaatccagacaagaagacagcctactaaaacttgacccaactgagattgaggaagacgtaaaagttgaaagtttggacgcatcgacattaaagtctgccttgaatgccgatgaggcaaatactgatgaaacagaaaaggaggaagaacaagaaaagaaacaagaaaaggaacaagaaaaggaacaaaatgaggaaacggaactagatactttcgaggataacaataagaacaagggtgacatcttaatacagccaagtaagtacgattctcctgttgcttctttgttttctgcatttgttttttacgttagcagagaagttccgatcgatattcttgagttcttgatcttatcttgtggtggtaatgtcatcagtgaagctgctatggaccaaattgaaaataagaaggatattgacatgtccaaggtcactcatcaaattgttgacaggccagttttgaaaaacaaggtagctggcagaacgtatattcagccacagtggatatttgattgtatcaataaaggcgaattggtacctgccaacaaatatcttccaggggaggctcttccacctcacttaagcccatggggtgatgctattggttacgatccaactgctcctgtcgaagaaggcgaagaagaagaaagtgaaagtgaaagtgaaagtgaagatcaagttgaggaggaagatcaagaagttgttgctggagacgaagatgatgacgatgacgaagagctacaagctcaaaaagagcttgaattggaagcacaaggtatcaagtattccgaaacttcagaagctgataaggatgtcaataagtcaaagaacaaaaagagaaaggtggatgaagaagaagaagaaaagaaattgaaaatgataatgatgagtaacaaacaaaagaaactttacaaaaaaatgaagtattctaatgctaaaaaggaggaacaagctgagaacttaaaaaagaaaaagaagcaaattgccaaacaaaaagctaaactgaataaactagattccaagaaatagtttctcttcttttccaatagcctctcaaattttgtcttttaattttacatctttattactttataattcctcggtatagcaacattagatatataactacacatttttatttgtagatatagaaatacctgtacattaaaagtggttactgttgtcctgtataaccatatgagtgaattttgtaaaaatatgcccaggtccaatgattatattagaatatttccatgtgctaccctcgagtccattgactgtctatcgggtacacttaactctatgtagccttgtagttccttttttaagttcatcaaaacagtctctgtatagtttatacgatcgatatcggtccccctactaacattgatgtatgcttttaaaaggaaccctccgcttgttatttgtgaattgcctgcttcttctatttgccaaattttttgtaactcaagtattaaaccatgcttcataaaaaatttcacaccaattgtaagatactgaaattcgaatacataacccaatccgttcatgagcgaggatactgaagagtttttgccagctgaagataatatgatagtctcagctatcgtttgcattgagacacttctattgtttcctgcagcaggaatatctgaaatttgcaatgaccaaggggaacatgattcgtttgaaggggcgggacttgcatccatgtcgacatctatgatgtcatcgctgtttcgactttcatttacagtatcttctgtatgcttactgttgttttgatcttcgtttgtgctgttgaagttggtgacttgcggaactgtgttgtgcaagatattccgtgttatagcatagttaagcgggattttatcgtttgtaaaagatttcaagattctaaagtttaatggtttatccatcattgtttcatcgatcaggtaagaaaatggcacctctttggaaagttttattctatttggttcaaccaattggtttctagagttcacgttctcgacgtcgtaagatggatttggtttccagacggtgcataaactgttatacagtagcggaggattacctgatattgtggtcaaagttgaaattagtaaatcgtagccgtcatcaccaatagatccaaaaaggcttagttgctgaaccatcttttctccttaatatggaataccttggctggaaaattcaattttctacctttttttttattttggttgtttgtcttcagatatttgataattttctaggttattttatttttttcaaataaaagaaaggcaaaagggcactcactatatattactaacctgcgagctaaaatgaacgcaatactggaaagcaatagtagaaactaaccaagacttcaaaagaatcaaataatggctgtagatgttcctcgtgcggtgattaataaacttatgctgtttactgcagcgatggtggtactgcccgtactcacttttttcattattcagcaatttacgccaaataccttaattagtggaggtttagctgctgcaatggccaatgttgttctaatcgtttacattgttgtagcgttccgcgaggatactgaagatcacaaagttgatggtaataaaaaggaagactgattgagtagtatatgttgctagaagagaatatacaagaaaaatagtagaggctaaataaaaaaaaagtagcattaaatgttatggatgattgggatatatatgcaaataacccaatcttacatatgtttctttcaaatatatgagtatatataacgattaattgtttttttttattgggtttgttgatttttccaacgcaccatatgtgatatccaaattagatatccaagaaagtgcaacaatcaaaatgaacaatagcaacgcagaaactattaaacacattagtagtccttcagtccagatggagcttaaaatatcatcgtcgccttctttacccttgttgttatcatgatggctcaaagtctcttctgttgcatattcatcgtcaccatcttcatcctcaaaagcccaaccaagagagttaataaccacagtcaaattgtcgccagatttatcttccaaaaatgataagcaagaatcaataaattcatctaattttttcaaatcgtaggcattcgaggtaaacttgaacaaaacgatgcttttatcatctaaggagtattcatatagtaagtcagaggcactttcaggtaattcatccacagtaaattgttccataatgggagataatgattgagagatgttcaaaggcgaatcgtcatgaacagttaaactgacatcattggcaaagaatctattaaagaatgggtattcttcgtcaatcatcaagttgtccaataatgagaaattgtcaaattcaaaaacagcgatagcactgtcaacggatgatataacatctgccgttgaagatatagtgctgatggtatcccagttactctctttgtcgaacgaaataaaggaagagctttccttggatgaatctgcttgcacagttttggaaatacaacatgataacgtgaagatgaaaagggcatacagctgaccgaacaccattgctttaactttacagttcgattcttattatatatagtcacagcagtggttattatcaatgactttttaccctttttattcttgctataaacttatcaacagtttgctcttataagaaatagcgttctttctttctttcgtgtaatgtgacacaattttgctattgcggaaactgcagcatagtaagtgtaataatcgtactgttgctttttcattttttttttttttttttttttttttttttttnnnnnnnnnnnnnnnnnnnnnnnnnnctgttattgaatgttttgactagtctcatgaataaacattaatagttactaaagggttcacagcaactatgagaggaacaaaggtcacacaaatgatatcccttgtgttcaattgctgctaattatccgtggcggtttcacttgtattataacaacgaagcgtatctcagacagaagttatcgtactgttctcataataatgatgaggtgcgttctttctgacgctccgtacaaagtggtaatgttgcaccaattgttcaaacgtttctttcgtttataaaaagaatttcttaacaattcagagataattgaaatagcgacatgaagttatgagcttccttcaatctcatttttcgtgttttattcctttcaagagatggttcggacacacctcattcatcaatggagatgcctcagatatgaaaatacttgtggattttgtaaagattcaacctgtatggtctgcgtggattgccacttatagggcttttcatattagtattttaaaggagttaaatcggtttcaaaaggtcatgctccgcagtaattgacttgattttgcaaagcttcacctcaatagcgtatctttcttttataaattgagtttgctttaatcccttatccaacagatgaattggtactctggccgagtggtctaaggcgtcaggtcgaggtcctgatctcttcggaggcgcgggttcaaaccccgcgggtatcaatatttttttgaatctacacacttcaataagaattaggctgttaggatagcattttttttctatgtaccaaaagtattcatacgtggcaccttgttaccccacaaaacttttttagacttgagtgagctgaaagacacctaaaaggaaggacattccattgatggctattgtagccaaaaaaattaaaaaagaagaactcctcatagggggctcgaacccctgacatttcggtatccttgcttaagcaaatacgcttaaaagccgaacgctctaccaactgagctaacaaggatgagttcttcattttttctgtagtactctcttgtacttcctatctagtaaaagataaagattgagaaacagtcactaaatttaatagaagctaagatgcaaggattgatactgtattaggataatgtaatatataaaacggaaggagaaataatcgcaatattattatgtagaaatactgttttcattttgagaattcctatatcctggaggagaacttctagtatattatgtatatacctagtataatagcgtttaccaatactggaatctcaatgattatcagattactcacgaatttctttaatagaataatgaatgataccatacaaaatgggaaaataaaaattataaaattttcatgtacaattacagattcctttttggggatttctatattctcgaggaggaattttaatgcattccgtatgcccattaatatggcatttgataacaatgaatcccaaaaactgttccaagattcatatatttctcgcacccgttcccctaaactttatcccatcttagcgggttgaatccacgttaacattccactagtagattttccacttctgttacacttactgcgcaagtggctcgtttatcgtttatttactttgaaacagtgcgacggcactacaaaggagcgcgtaacaaacgttactatcccgtttcattgtttcagattatcaccatagttacatatgtagggaatggcaaccaacctgttccaacattctattcagaccgagaaaatccagtaggacttaacggtggttccgaaattctatttatatcattgctattagctttatgtatattggcaattgaagcggttcttcttcatgacataatagtccatcaacagttcgtgcaattgatacaaattaattttgaaggcaatatttaagtttggttttcttacgcagaatactttttaaagtatcaactttcgtgcatcagcttctgttaggttcaatgattgtttaattctggtcttcaggtcatataatttcacaccattttttttatgatcgcttcttgaaaattcgatgtaaggtaagtaatagcttcagtttgttgcatgagtaatatgcggaagataactgattgttattttagaagaaatcaatcaagatgaaaatatccactacttcgaaaatacgtagcaagccaagttcaatcggtaatctataggttcggcaagagactttgcaatgctaatgtttacatttccttgccacagttctcgttggaaacaagcctaatgttaacgtattttcacccgcattaaactacaattgttttggacgtaagaatttacagcgcaattattcttttctattttatcattatgattgttccaagagcttcttgcgttatttaccatatattcttgatctatgaatgataataaacaagagtaaatgaatgttttatatgttcataatgacaacaactgggggggggaaatgaaaatatttatcttctattcatagtaaaaataatcttaaaattgaaactaacgctgaaaactgcaacagttacggcatttttttattgatgcgtaaaagcattgtcttcgtcaatttttgaactatcgaattgctccataatatcattcatggtgttatccaattatttagtaagcttcgcttgtactcagtcattttttttttgcatccaattttattgaaagtccgcccgctctgttaaaaaaggcgtttcttctaaatttgaataggctacgatcgagattccctccgattaattatgtgctactggctcctctttcgtcgtattgcaagtggacttttcaacgaggctatgcatgcccagtgtcattcttgaagcaggcacacacagacgcgcttcaattagttttctttactagatgcatcatttgggcggtttttcactaccgttttcgagtaggggctctcacaaaacgggcacgaccttttgtttacaaccgcccaaagaggaaaaacatcaacaatcaagaagcggacacaaaatatagaagcaccataaaactcacgtcaacggtaactttaaatttgttgtattaattaatcattttcaacttgcatttttacagcatcatttatgagtatcctgcaagttaggtgcggaacgtacataacatattacttcaatttgcgttccgcatacggtctgcccaatttgttttgtttgtgatttcctcattcgtcttcctctgcagaaacgggtttgatccttcttttatgaatacggcgtgtagttatatatattaagtaatagaagttattgcacttctgtgtaagaagaagatactagggtgatctattctaggcaattttggttgtattgtgttttttacattcggccaaacttgagcaggctgcaattttagtgtcttcggtttttccagcgacagttttacttgtggctcttggtatagtttcttaaaactattaaagttgctaactggtgcagctgtttagatcacaaaagcgtaattaagaataagatctaccaacaagaacagagccaaaatattttcgtccgttatatcaaccatcaaaggaagctttaatcttctcataatgtcacgatcccttttggtagagaatagtagaaccattaatagtaatgaagagaagggggtaaacgaaagtcaatatatcttacaaaagagaaacgtcccaaggaccattctcggtaatgtcacaaataatgcaaatatcctgcaagagatttctatgaacagaaaaattgggatgaagaacttctcaaaattgaacaacttctttcctttaaaggatgatgtttcgagagccgatgacttcacctcctcttttaatgacagtagacagggggtgaaacaagaagtactaaacaataaggaaaatattcctgaatatggatattccgagcaagaaaagcagcagtgctcaaatgatgactcttttcatacgaattcgactgccttgagctgtaatcggttgatatactctgagaacaagtctatttccactcaaatggaatggcagaaaaaaataatgagagaagattccaaaaaaaaaaggccaatatcaactcttgtagagcaggatgaccagaaaaagttcaaactccatgaattgactacagaagaagaggttctggaggagtacgaatgggatgacctagatgaagaagattgtgatgatcccttaatggtgagcgaagaggttaatgatatcttcgattatttgcatcacttggaaataatcacattgccaaataaggcgaatctctataagcataaaaatattaagcaaaacagagacattttggtgaactggataatcaagattcataataagtttggccttctgccggaaactctatatttggccataaacataatggatagatttctttgtgaagaggtggttcagttaaatagattgcaactggttggtacatcatgcctgttcatcgcatctaagtatgaggaaatatactcccctagcataaaacattttgcgtacgagacagacggtgcatgctctgtggaagatattaaagagggtgaaagatttatattggaaaaactcgattttcaaattagtttcgctaacccaatgaatttcttaaggagaatatcaaaagcggatgactatgatatccagtctaggacgttagcgaagttcctaatggaaatatctatagtggacttcaagttcatcgggatattaccgtcattatgtgcctcagcggcaatgttcctttcgagaaaaatgctgggcaagggcacctgggatggcaacttaatccattatagtggtggttacacaaaggcaaaactatatcccgtttgccaattactgatggattatcttgttggatctactattcacgacgagttcttgaaaaaatatcaatcgagaagatttttaaaggcttccataatttctatcgaatgggcattgaaggtaaggaaaaatggatatgatattatgacattgcatgagtgaaggtgctagcctacacagaaaaccaaaatctcacttccttactttatcatctattttatagaaaaatcaggcattcattattcatataacggttatctcatatatattatcacacggtatcagttttgtaggctgtaataattaattcatttataaattttttctcccataattggaaaattatctttaaagtgaggaataatgcattttctttctttttttgaatacataaaagaaataaagaagtatgtctatcgatgatatttaagatgcagggggttagctggctataattttgatctatgtttcaacgtttttgtttacaccagtcaaaaaccttgaaataaaccatgccatgtttaggctttttgtatttaagtctcaaggaatctagattcgtatcaggtacagcaatatcttcaactagttcactgataaaatccttaaacgctggatctgattcaatatcaatgccgccactataatgaataaaagtttcatcccatttggaattttcatttttaatttttctggcgatatacatggacattgcagctaaatatgatggcttcaggtggatgaatttattacaacaaatcgaatattccatgatgaatttggccatgttccttgtttcaatgcagtaattgtcagcttttgaaattctcctaatgaaatttagggggtttggtagagatatgttataacctaaagaacttagaacgaatagctcagccttcctaattccttcgacagtggcagcaccgtcagtcacgtacgcaaaatttgttatttttggtaatttaacttcttcaaatttacaggcaatgaacaggcaagtgatgcatagtagttgtaatttattcaatttaacaacattttgtgataaaaatcgatctagcaggttgatcgctaaaaataatgtttcaggtaagcagtgaaatttctcatgaacttcaaccaaccagtcaattaacagcgccctcatggagcttttcaaatgatagggagattgcgtgtccattaaatagttatgtgtcggtagcatttggatttccttctcgtaaagatgagaaaatatagaatctgtatattctgctaccatgaatggatcatccatctctatcgaatccaaatttttccattgatgacattttatttttttcacagtttttggctctataggatcggttgaatcatttgataattgtctctttcttgttttttccaaatgggtggaatctctttgcaatttacctcgagggagttgtaaagaatcgattttgttactgtttacctcggatagaacttttttttcattcgtagagtgaggtgtcaagttaattgaactttctcttggaatggtatggaaagcattttccttgcctatacaatcttcattattaatttggattttcctttcactaattggactagggatacaattcattttaaaaatttaaaaggagggagagaatatcagagaataataattttcaacacactgatttgtatgttgtatgaacgctagattagtgaagcttgttattatttaataaaagataaaagtcacttgtatgaaatgaagcagttatatatatgttaataagaaaaaggcaaaaacttaaccctagcaaaaaaggtaatcaatgtgctaaaacggtaaatatttaaacgcaggttgcgaattgccaattgccaattgtaggatacacagggagagtagaaacaaccaagtcctgtgtcctgtggtagacccacttgttttaccgcagagggccctttttttgtttaccgtcgcaaaaaaaaaacgcgaagaatacgcgttggtcgttaaattttgtggtacgcgtaaaactgctatttggtatcctctttagggacgcgcccattgtctatacggtaatatagggctttcttcattacctgcttgcgtcaattagctttactcatgtaacacataataacctcttacattgtaatgaggcccaaaaaaaaaaagaacatcttcaaaaaaaaaaaactttcatggaaggaccacctagttaataaaaagctcgcactcaggatcgaactaaggaccaacagatttgcaatctgctgcgctaccactgcgccatacgagcttgattttctgaaagtgttgtatctcaaaatgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacacctggtagcgttaaaggttactaattgttcaaacgaaccatcgaaaagccgaacctagctacaccacaccccagtatgagctttatggatcaaatcccaggaggaggaaattatccaaaactcccagtagaatgccttcctaacttcccgatccaaccatctttgaccttcagaggtagaaatgactcgcataaactgaaaaactttatctccgaaataatgctaaacatgtctatgatatcttggccgaatgatgccagtcgtattgtgtactgcagaagacatttattaaaccccgctgctcagtgggctaatgactttgtacaagaacaaggtatacttgaaataacattcgacacattcatacaaggattatatcaacatttctataagccaccagatatcaataaaatctttaatgcaatcacgcaactttccgaagctaaacttggtattgagcgtctcaaccaacgattcagaaagatttgggacagaatgccaccagacttcatgaccgaaaaagctgccataatgacatatactaggctattgacaaaggaaacctataatattgtcagaatgcacaaaccagagacattaaaagacgccatggaagaggcttaccagacaactgcactaactgaaagattcttcccaggattcgaacttgatgctgatggagacactatcatcggtgccacaacccacttacaagaagaatacgactctgactatgattcagaagataatctgacccagaatggatacgtccataccgtaaggacaagaagatcttacaataaaccaatgtcaaatcatcgaaacaggagaaataacaacccatctagagaagaatgtataaaaaatcggctatgcttctattgtaagaaagagggacatcgcctgaacgaatgtagagcacgtaaggcgagttctaaccgatcttgaactcgaatcaaaagaccaacaaactccttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcatataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccatccagagtgtagaacataatgctactgatcacagcaataaggacaccttttgcactttgccagtttggttacaacagaagtatagagagatcatacgtaatgatttcccaccaagacctgccgacattaataacatccccgtaaaacatgatattgaaattaaacctggcgcaagactacctcgactacagccataccatgttacagaaaagaacgaacaagaaatcaacaaaatagttcaaaagctgctcgataacaagttcattgttccctcaaagtcgccttgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcacaccatccggtaagtatgaatataccgtcatgccatttggcttagtcaatgcacctagtacattcgcaagatacatggctgatacatttagagacctgagattcgtcaatgtttaccttgatgatatattaatattctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccaaattgctccaagattgcacagccaatccaactgtttatttgtgacaaaagtcaatggacagaaaaacaagacaaggcaattgataaactaaaagacgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttagaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacctagctggacccaagaacgttgtcgcagatgccatatcccgtgccgtatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactatatcatgaccataccttatttggaggacattttggtgtaacagtgacccttgcgaaaatcagcccaatttactattggccaaaattacaacattcgatcatacaatacatcaggacctgcgtacaatgtcaactaataaaatcacaccgaccacgcttacatggactattacaaccactccctatagcagaaggaagatggcttgatatatcaatggattttgtgacaggattacccccgacatcaaataacttgaatatgatcctcgtcgtagttgatcgtttttcgaaacgcgctcacttcatagctacaaggaaaaccttagacgcaacacaactaatagatctactctttcgatacattttttcatatcatggttttcccaggacaataaccagtgatagagatgtccgtatgaccgccgacaaatatcaagaactcacgaaaagactaggaataaaatcgacaatgtcttccgcgaaccacccccaaacagatggacaatccgaacgaacgatacagacattaaacaggttactaagagcctatgcttcaaccaatattcagaattggcatgtatatttaccacaaatcgaatttgtttacaattctacacctactagaacacttggaaaatcaccatttgaaattgatttaggatatttaccgaatacccctgctattaagtcagatgacgaagtcaacgcaagaagttttactgccgtagaacttgccaaacacctcaaagcccttaccatccaaacgaaggaacagctagaacacgctcaaatcgaaatggaaactaataacaatcaaagacgtaaacccttattgttaaacataggagatcacgtattagtgcatagagatgcatacttcaagaaaggtgcttatatgaaagtacaacaaatatacgtcggaccatttcgagttgtcaagaaaataaacgataacgcctacgaactagatttaaactctcacaagaaaaagcacagagttattaatgtacaattcctgaaaaagtttgtataccgtccagacgcgtacccaaagaataaaccaatcagctccactgaaagaattaagagagcacacgaagttactgcactcataggaatagatactacacacaaaacttacttatgtcacatgcaagatgtagacccaacactttcagtagaatactcagaagctgaattttgccaaattcccgaaagaacacgaagatcaatattagccaactttagacaactctacgaaacacaagacaaccctgagagagaggaagatgttgtatctcaaaatgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacagaaagttccattttggatgctctatttatgggaatatgactatacgaatgtcacccacgatggccggagtagctgtgatgagcatctttttgtcctgggcggcttaaaacgtgagcaaaattgtactgtaaattacttacgttatcaatggaagtgtgtgaatttcgtgataaaattattgtcagaatagtgacttcattattctttataactaaccattaggatcatataagtaatcagatgcagttcgtcattaatatgtcaggatggataaccataggtaagcacgtgattatggaaggacagtaaagttaccgatctacttttttgaatgatcaacttggtgttttcatctataaggatatgggtcgttacattgaaactatagtaaaagatctcgttattggtatatcggtcataatgaagatgaaatagtcggtatgtatttttatacccccccctatatggtaaaaaggttaagattcatatttaaatcttcattaataccacctctaatttctaattaccaacatttttaactccacttttattatatgctatatacaacattatgtaaaaggagtataccaaaaattctccttcataatataggaattcacaaaatggaaccgatatctccgcataatgctattatcatttcttactcgttttatacattgtcattcattatcttattgcatttgcaatccttgttttccggcttctgtgaaatttgacgactgattctcaattttatgtcatctttttacacttatatatgacaatatactagtagtatgaagactaatcaacggaggttatttgatttctattctaacttatttgaacatatataatttgtaaattttatgcagattagacttgggagttatcacaacattttgtcagtgtttagcctctttcacctttgcctttttcagccttttttgtgtaaattgatggtgtagtttgtttctgaaagggctctttttatttttttcgcttccgccgttcgttattggataatccccgaaatatgctagagtggctgatacattatagaacataaaagtgagctgcaatgagcactcaagcacgttattgacaaggataacggaaaggtacactaatacttatactgattaataagggttagccttttaatgttcaagtcaactttaaactccataataagaagacccttgaaaggttttcaacttcttagaggggctgactcatcgaatacacggccacagtcccctagagcctccgcaagagatgttacagagaaacagatattaagaactccgtcagcaccaactgcaataccattaagggagattatctatagagtcccaagcttgtttcctcgccctttagaagattctgttaaggacttccgagattttatcaagaacgaggatgcattccagactgaacttttgaaaacgctgccattctaccccactccttcggaatcaaaaacagcaagacttataagaactgttgttgatgatgagggcaattacatcaatgaattttgcatacgccctcgaaaaacctcagtgcctgaggctgacttaaaacatctggttttcattcatgggtatggcgccggattgggttttttcatcaagaattttgaggatattccactattggataacgagtggtgcatacatgccatcgatttgcctgggtatggtttttcttcaagacctaagtttccgttcgagtatccgagagataatattcacagcgttcaagattggtttcacgaaagaatacacacatggtttagtaaaagaaatcttttgaaccgacctgagaaaaacattgttatggcacattctttagggtcttacttgatggctttatatttgcaaaaatataaggaatctccatcttttaaaaagctgatcctttgttccccagcaggcgtgtcttatagagatttcaacaatactgcttcagaggttgaaaaatggaaaccgcctccttggtggtatgtcaagctttgggacagaaatatctcgccttttacactagtaagaaattttcgccagttaggttcgaagattacaagtggatggtcatatcggcgctttaagcacattttgaatggtgatccagaacagtcaaaacggtttgaagccttgcatagatacgcatatgctattttcaataaacgtggttcaggtgaatacttattaagctttgctttgaaatgtggtggtgaaccaagactatcattggagcagcagctattcgatggcaaaaagtctgatattttaaagaatagtaattgtgactggctttggctttatggcgatgacgattggatggatgtgaatggtggacttagagtatcaagattcttgaaagagaagttgaaacaaaaaagtaacgtcatcattgttcctcattcagggcatcacttgtacctggataactataagtttttcaataatattcttacgaaagaaatgcaaaaaatataatgaagaaatcttgtgcatctacattatataacgaaatttttacatacattttcgccgctatttttcttcttatctcaaaatgaaattaccgtttgcaatcaacaccggtcgctgttttattttgttcataataataatttagatacagcatgaactgtatattaaagtcaacgatttcaacaattcatttctgtgtaactatttttccaatagaaccactgtctttatggagtagttgggctctataaaaattatttagttccaaagtttgtttatattttgtttctataataatgtattgaagatataaacaaacataattttactgttaacatttaggcgcaacaaaaggacgatctttttttatttatcacaagttaaagattttcgatacaaataatattgtggtttaaggtacgtccaactctacttaaatcactgaatccttcagataacgaaattacgaataatatctactctgtttctccttgtctttgttctttcttgcagccagccaagcccattcgggatcagagattcaaatatccctgacggctggttctggattaagttgattttgtggaacttctgtcttcacaattatattgttacccacttaatgcttctcgggggttagaaacactagcacttgaaagaacatgaaaaattagaaaaaaaaaaaacaatgcacaataaattccaggggttagcgactttatacttcttctgttagctactgtagtgttctgtacacatattcacttgtagaagttgattagaatgacagcctcatcaaatgacgatgacctaatattcgaatgttatagcgatcctgagttaaaaagatggacacaccttgctaatgcaaaagcttggaaaggtattctgaccgtgcagcagtacgctgatagggaacaattgctagggtcttcagagatttctcaaaagaataaatcaaatgaaatgatgacaaaatacccaaaaagttaccagtggcttgggcagaagtactttgttttaaaggatcgatctttgccagataatggaaaatttagtcaagttgtttccagttgcgaaactttaaacaggattggatattgtattcatccgggttctaatggaaaaatcgagccagctttgattgtatgcattgggggcgtctttacctttgaaaaccatcgcggcaagggctacgccaagaagatgattatcaaactgaatgaattttatgacaagattcgtgatgacgctaacaccgtactagaattgaaaaatttggtgattaacctttacagcgaagtcggagaatattattccgcattaggatacgagagtatgcatgttcccttgcaccgcatttctaaattagatgaacttactgagagatactgtggagaagatgatgaccatgatggtaagtacttgggatttgatgattacaggggtttagtaggactacatgagacacagttcaaagaaagcttattaagtttacacaaagaaaacccagagaagtttgtttttaccgttgcgccagactttgacattttcacatggtttcagtatcgtgatctttttatcatgaataaatcaggaagaaaagcccagcaaaatctgttttttggatacgcgttgagtgataacagccacatcatatggcatcacaattggaacggtgattctctgattattgtcaaaatccatatacctgaagaaacatttcaaaggaaagaattgaagctcaaaaaattactaaggaaggccatagaagagacaaagcttcatggattgcaagaattagaattttgggacgaagaaattcccatcaaaaagtacccacaattgtttcagttattaacagagcttgaaaatgaatctaaagttttctcagaaaacggttccatcagtgctgttcgtccccccaaaggatatacagccgagcaggtaatttgggataacaataccaaattctgttggttttaagtcaaatattgtgttgcttatacaggaaaagtcaaggtttcaaactacatatcattatttactgttaaaattcacatatactaatacatacggtaatagattgaacctcttctgtgctcttctctaaaagtacttctgaacgtatgtgtcatttttcctttcagttttctttgtagctcgcattgatgtagccgagtatatttaagggattcttatgcaatgatgaaatatttttcacctataacgccgactactgaaaacagagggccatcttaaccgttttgcattcagtaacccatactcaggatttaataaaagaggaaagcaatgtctctactaggcgccaggtccacttaccgttggttttcaatcgctgcatcaattccgactaagaatgctattggcaaatccacgtacctcttagcttcaagaaatcaacagtaccgaggcatcataacgtcaactgtagactggaaaccaatcaagacaggtaagagcccaaatgatgattctcgaagagaaagatcctttggcaagaaaattgttctgggtctgatgttcgcgatgccaataatatccttctatttgggaacttggcaagtaaggagattgaagtggaaaaccaagctgattgcggcatgcgaaactaaacttacttatgaaccaataccacttcctaagtcatttacacctgacatgtgcgaggattgggaataccgtaaagttatacttaccggacacttccttcacaatgaagagatgtttgttggtccaagaaagaaaaatggagaaaagggttattttctgtttacaccgttcattagagatgacaccggtgagaaagttctgatagaaagagggtggataagtgaagaaaaagttgctcctgactcaagaaatttacaccatttgtcgttgcctcaagaagaacacttgaaagtggtttgcttagtaagacctccaaagaaaagaggctcgctacaatgggcgaaaaaggatccaaattctagattgtggcaggtgccagacatatatgacatggcaagatcatcagggtgcacgcccattcaatttcaagccttgtatgacatgaaggaccatccaataatcgaggaacacacaagaaacgaggcttcacaaaacaattccacctctagcctgtggaagttctggaaacgagaacctacgactgctgtaaacggaacgcaagctgttgataataatacatcgaagcctcgttctaggcaggaaatgccgacagaccaaacaattgaattcgatgaacgacagtttatcaaagcaggtgttcccataggccggaagcccactattgatttaaagaataaccatctacaatatttggtaacgtggtatggcctttcgtttttgagcacaatcttcctcattgtggctcttaggaaggcgaaaagagggggcgttgtgtcccaagaccaactaatgaaagagaaactgaagcattcaaggaaatatatgtaaacggcaaactcctctgcccatactatcgaactctatccaagaagcgcgtaatttcacgagcactgcctaaacggttttccacattagttttgcaactacaatgattcggatatggcacatttacataatttaaacttgtacataactaacacctttttatccatataccttatgtgccgctcaagatatgaacattgcgcgttgcccggacaatatcgataaataatagccaaaacaaacatgttttatcgacgcatgaatcctttggcgttaaacttgtccaattgcactgaaacttggagcgtataagctcagcaattgcaccaaaacaatatcagaaaaggcttgtattgccactttcacctatgagcgaagataaagctaaattagggaccacaaggtctgccacggaatatcgtttatccattggtagcgctccgacttcaagaaggtcgtctatgggtgaatcctcatccctgatgaaatttgctgatcaagagggattaacgagttccgttggcgaatataacgagaataccatacaacagcttctgttgcctaaaataagagaactgagcgattcaatcattactttagattccaatttcacgcgcttaaattttatccacgagagtttagctgatcttaatgaatccctaggttcgttgttgtacggtattatgagcaattcatggtgcgtagaattctcacaggcgcctcatgatattcaagacgatttgatcgctattaaacaattgaaatcgttggaagatgagaaaaataacttagtaatggaactctccaatatggaacgcgggattaaaagaaaaaaagacgaacaaggtgaaaatgatttggccaaggcatctcagaacaaacagtttaaccagccgctatttccctcctcacaagtaagaaaatacaggtcatatgacaacagagacaagaggaagccctccaagataggcaacaacttacaagtagagaatgaggaggactatgaagacgatactagtagtgaagcttcttttgttctaaatccaacaaatatcggtatgtccaaatcatctcaaggtcacgtgactaaaaccacgcgtttgaataataataccaacagtaaactgagaagaaagtccatcttacatacaatcagaaatagcattgcttccggcgctgatttacccatcgaaaacgacaatgttgttaatttgggagatctgcatccaaataatcgaatatcactcggaagtggtgctgcaagagtggtcaatgggcccgttacgaagaacagaaattcaatgttctcaggacgtgctgaaaggaaacccacagaaagcagacattctgttgcaaagaaaactgaaaaaaaaataaatacaaggccccccttcagatgactacgcccaacccaaccaaagaattatcctcctcacaaaatatatcgctagcatgcgtgagttatggataagaagaatatttgatgagctgactgattctttatagcaatagggaggaaggcagtacacatatcagcagtgcatgggcacaacccgcattacaacgaaacatgatatatctatataaaagaagatacggacaggcggtcgaggctattactgtgccactatgcgagtcatgaatgatttttaaattagttagtacccctttatataacgtcttcaataaaagtgcgggaaaattcgggtaatattttctataactgtcatttttttttcgttatgtatggcaaaccaaattgacaagaaactggacaacggttaaagcaaaaggaggaagaaagatattgatttgtgctttgaagaataacccaagcgaacaggtcattaattgcctagaatctttacatagaatttgccttttatggaagagacgggagattcgaagctggtccctagggacgaggaagaaatagtaaatgacaacgatgaaactaaagcgcctagtgaggaagaagaaggagaagatgtctttgactcctctgaggaagacgaagatattgatgaagacgaagatgaggcaagaaaagtgcaagaaggcttcattgtcaacgatgatgatgaaaatgaagacccaggaacaagtatttccaaaaaaagaagaaaacataaaagaagagaaagagaagaagatgatcgactatccgaagatgatttggatttgttaatggagaatgctggtgttgaacgtaccaaagcgagctcctcttcaggaaaatttaaaagattaaagagagtaggagatgaaggaaacgctgcagaatcagaaagtgacaacgtcgctgcatcaaggcaagattctacgtctaaattggaagatttcttttctgaagatgaagaagaagaagaatctggtttacgcaacggtaggaacaatgaatatgggcgtgatgaagaagaccatgaaaataggaacagaacagctgacaaaggtggaatcttggacgaattggatgatttcattgaagatgatgaattttctgatgaggacgacgaaaccagacaaaggaggatccaagaaaagaagcttttaagagaacaatccatcaaacaacctacacagattactggtctatcgtcggataagattgacgagatgtatgacatttttggtgatggtcatgactacgattgggctttagaaattgaaaatgaagaactagaaaatggtaacgacaacaatgaagctgaagaagaagagatcgatgaagaaactggtgctataaaaagcaccaagaaaaagatatctctacaagacatttatgatttagaggatttgaaaaaaaacttgatgactgaaggagacatgaaaattagaaagacagatattccagaaagatatcaagaattaagagcaggtattactgactacggaaatatgtcatcggaggatcaagaattagaaagaaactggatagcagaaaaaatttctgtggataagaacttcgatgccaattatgatctcactgaatttaaagaagcaattgggaacgcaatcaaatttatcaccaaagaaaacttggaagtcccttttatatatgcttaccgtcgtaactatatttcctcaagagaaaaagatgggtttcttttgactgaagatgacctttgggatatagttagccttgacatcgaatttcacagtcttgtgaacaaaaaggattatgtccagagattttatgcagaattacatatcgatgatcctattgtcactgaatacttcaaaaatcagaatactgcatctattgcggaactgaattctctacaggatatttatgactacctagaattcaaatatgccaacgaaatcaatgaaatgtttataaaccacactggaaagactggtaagaaacatttgaaaaattccagttatgaaaaatttaaagctagtcctctttatcaagcggttagtgatattggtatatcagctgaggatgttggtgaaaatatcagttcccagcatcaaatccaccctcccgtagatcatccaagttccaaaccagtagaagtgatagaatctatattgaatgcaaacagcggtgatttgcaagtctttacgtccaatactaagctggcaattgatacggtccaaaaatactactctttggaattgtctaaaaatacaaaaataagggaaaaagttagatccgatttttccaaatattatctggctgacgttgtgttaactgctaaaggtaaaaaagaaattcaaaagggatctctgtatgaggacataaaatatgccatcaatagaactccaatgcacttccgtagggatccagacgtttttttgaaaatggtcgaggctgagtctttgaacctgctcagtgttaagttacacatgtcgtcacaagcccaatatatagagcatttattccaaattgcacttgaaactaccaatacctcggacatcgcaatagaatggaataacttccgtaaactggcattcaaccaagcgatggacaagattttccaggatatatctcaagaagtcaaagacaatttaacaaaaaattgtcaaaaattggtagccaagactgttcgccataagtttatgacaaaattagaccaggctccattcattcctaatgtcagggatccaaaaattccaaaaatcttatctttaacctgtggacagggtagattcggagccgacgctataattgctgtctacgtcaacagaaagggtgattttataagagattacaagattgtcgacaatccatttgataagacgaatcctgaaaaatttgaagacaccttggataatatcattcaaagctgtcaaccgaatgccatcggaatcaatggccctaacccaaagactcaaaaattttacaaaagattacaagaagttctacataagaagcaaatcgtcgacagtagaggacatactattccaatcatttacgttgaggacgaagtcgctatccgttatcagaattccgaaagagctgctcaagaattccctaataaacctcctctagttaaatactgtatcgccttggcgcgctatatgcattccccattgttggaatatgctaatttaacaagtgaagaagtgagatcattgtcaattcatccacaccaaaatctgttatcctcagaacaattgagttgggctcttgaaaccgctttcgttgatattgtcaacctggtaagtgttgaagttaacaaagccacagataataattactacgctagtgcgctgaaatacatctctggctttggaaaacgtaaagctattgatttcttacagtcccttcaaaggctaaatgaaccattactggctcgtcaacaattaattactcataacattcttcacaagactatttttatgaattccgcgggattcctctatatctcatggaatgaaaaaagacaaaaatacgaagatttggaacatgatcaactagatagcactagaattcatccagaagactaccatttggccaccaaggttgccgctgatgctttagaatacgatcctgatactattgccgaaaaagaagaacaggggactatgagtgaattcattgaactgttgagagaagatcctgaccgtagagctaaactagaatcactaaatctagaatcatacgcagaagaacttgagaagaataccggattaagaaaacttaataatctaaatacaattgtccttgaattgttggatggatttgaagaattgagaaatgactttcatcctttgcaaggtgatgaaattttccaaagtttgactggtgagtctgaaaagacgtttttcaagggtagtattattccagtcagagtagaaagattctggcacaacgatataatttgcactacaaactctgaagttgaatgtgtagtaaatgctcaacgtcacgcaggtgcacaattaagaagacctgcaaatgaaatatacgaaattggtaaaacatatccagcaaaggtgatatatattgactatgctaatattactgcagaagtttccttattagatcatgatgtcaaacagcaatatgttccaataagctacagtaaagatccttccatttgggacttgaaacaagaactggaagatgccgaagaggagaggaaattgatgatggcagaagcccgtgcaaagagaacacatcgtgttatcaatcatccttactatttccctttcaacggcagacaggctgaggattacttaaggagtaaagaacgtggtgaattcgtgatcagacagtctagccgaggtgatgaccacttggttatcacctggaaattggataaggatttgtttcaacatattgatatccaagaattagaaaaagaaaatcctttggctttaggtaaagtcttgattgtcgacaatcagaaatacaatgatttagaccagatcattgtagaatatcttcaaaacaaggtaaggctcttgaatgaaatgacatctagtgaaaaattcaaaagcggtactaagaaagatgtggtcaagtttattgaagactactctagagtgaatccaaataagtctgtgtactatttcagtttgaaccacgataaccctggttggttttacttgatgttcaagattaacgcaaatagcaaattatacacatggaatgtgaaattaacgaacactggttatttcctggtaaactacaattatccaagtgttatccagctttgtaatggttttaagacgcttctaaaatctaacagtagtaagaatagaatgaacaactaccgttagatgcgtatgtagtgtccattgttattattaattttattattactttgaccattgtttaggtaaggtatgtaaactagaacgcttcaactgtattttttacgtaattatttgctgcatgtttagtttcgcaaagtttgtaccgtgacgaacatagcacgaacacaacatttaatagaaatagcttgggaaccaaaattttagaaatttttttcactaatgagaaggaaagcgttgcaaagtggcgactattttggttcttcaaatatttgcaggaaataaataatttactgtgcatttctgattacatttaggatgtaaattgacttagtagacgttccagcgaccattctcatttggtccttactgatatccatacactttatcctgtcgtgcaaggagtttgcctcaccaggaatatttaaaattctcgaatcaccagtcatcaaatcaacactgtaaataccttcatcatttcctaccaatacaccattagaagattctaatttgccgagaattggtaatgagaaatcatcttgatatatttctgtcgcaaaatttcgtaagattttatcgtagtaagtctgaactttatccaatttcattgcctttggatggcctgtattcataggtatttctactaaaatcaatctcatgtatggtttatgtgacgtggctacaactagcatggtactgggtgataatcctatcgtatccttagtattggaatgaacataatctactgccattacgtctcgaatgttgaaagcgtacgtgctaaattccgcattgtttaaggcaatattgtatgaatggacaagatttttggcatctataattgagtaacatgctatatgagtgtattctgctctggtaagaaacacagagaaactattctgaccattgccgtcaccgttggcgattacattcaacgacgtacaattggaagccaactttatttcggagagttttgtgaggaaagtgttcccgttttttatctccaacaaactcaatcgcaggaagttatccattccactagtaataacaaaccaagatgattccgtaacattgcagatctttatatgcgtaatcattctggcatgaattttccatactgcgttgttcaccagttcaaaatcgttatttagcaagtaaaaacttccgttcattggacatacatattggtaaccggagctaccaatgggtccgtacagcttgacgatgctcttgactttttcattaattttaaatgacttcgacgtcgctttctcaatgtcgtagattactaggtatccagtagctgacgaaagtaatatatatttgctatcttctgtaaaagttgcgctaatgaacaaggtatctttgggtaaggatttgttcaattttacatcaatactaaatttcaaactatggttccaaggttgaattccatacttagcattgtcaattggggctaaatcatcgtttattgaaagagttttaaacctatctttgaaagaccgtcttttgtagtaaatcctatcttcaacgacactctgcaagtcttctagcggtatctcaccgacattactatttgaactatcggacttttctaaggcagaaagaggtaacgctgtctcccttatgaatgcagctaatgtatcttccagaccgttatgtttgagataattagctatcaatagattagtataaaatctggaagtagaattgtcagccatgtcggtcgcactagacttttcttctcactgtcacttacctgtttgaaatcatgtcctttttttttttgccattcttatacattttctttccttctgaaattaactgtacacccataccctatatacacccataccctatttttaaatataaaaagtaaacttcattttgaaagaccactctgcatcagcacgcgggctctggaaggaagaaatgacgtttcggcggaataccctttcagaaggtctgctcttgtggctggttcatgggagacacccagcggagctcctcccgagaaaggccccttcatctctgccgattgctgacggaaagcagtagcggaggtttgagttctctacgccgagagtacactgccgtaatatcacaatgtttcgactaacggttacagtacgttaaattagatactgcctatgaattgacatattagataatgtcaaattttacaaaaacctaagacaacaggaaataaacaaagatgggtaaaggtaagccaagaggtttgaactctgctagaaagctacgtgtccacagaagaaacaagtatgttgactatttcaaaattaaaaaaaactatcaaccccctattgtgatatcgttttaggtgaaggaaatgttgtgagctctggagtgataaatttatcagtaacatatcctggcgcaaatcagtttggagaggcttaaaatgacacgtcacagtgataaaaagtaatgaatagtgaacggtcagcttcggccattcttcccaatctatagtgtggaaaataaaccttttcttcccaaaataactcagaaagtcacaggaggccgttttttacaacggaatcatttttttactaacagtttttttttattattatagccgttgggccgaaaacaactacaagaagagattgttgggtactgccttcaagtcttctccattcggtggttcttctcatgccaagggtatcgtcttggaaaaattgggtatcgaatccaagcaacctaactctgctatcagaaagtgtgttagagttcaattaatcaagaacggtaagaaggtcactgctttcgttccaaacgatggttgtttgaactttgtcgacgaaaatgatgaagtcttgctagcaggtttcggtagaaagggtaaagctaagggtgatattccaggtgttagattcaaggtcgttaaggtctctggtgtctccttgttggctttgtggaaagaaaagaaggaaaagccaagatcataagcacgaaagttatcctctcgaggactacattgtttttgtaccttaatgtatctctttattcttccagaaagttccttctaatttcttattaggaatgggagagaatcacatcaatattttctctttaatagaatgtataattcaatagaaaaaaacaacataatttgcactttattttgatgctgagaaaagttttatagtgaatgtctgcttcccttgggttgaagttctgttcatatactaagttggttaataatgctatatatgtaatagatcgatctttatacaattcagtcattgatttaagtaacctgattacgttttatttttatatttttttacaattgcagcatctttctctaaaacctcatttaaatatgttataccgcgttgttgattcgtcagaatttccactatcttattaatacgatcattagattcttcaccggtgcctttggacatgctgtcttggttttttgtatcgtcgttgaaaaccattaatttactatctaattgactagaaatgtttttagcacgttcttttaagatagccaaacgtgcccaaagttcgttagtcttacctaaacctgcaggatcttcgctccgctgtagtaaagtttggaattgcgaccacattttctcttctgcaatacccaatggcagtcctctatttttcagggttgccaattgtgtgcccaattttaagattcttttttcaatttcaacattccttgattgtgccttcaaaattctggacgcagtgtccaattcatgcttttgttgcaattgtgtggatttctctaaaatatggttcaaaattattctagcttgggctacattttcagtctgtacttgattacgttgattcaaaccctcaaatccatatatttgaatgggaattgtctgaggggaaggtttcttttccattgcctgatcccactcttcttgaagtacatgtcctggttttgtatataaaatggcttccgtttcgttcactttattgtacacgaaagccctgagttttgttttcgttgtgtttggatcccacgattctttacatttcaacacctgttcttgaatttgctgcggataattagacagctgctgttgttgagcaattgcttgcgtttgttgcaacggtacttgaatttgctgctgctgctgctgctgtaaattagatccagttgaaggcttagaccaagcaaatgatggttgtgtggataccgtgtttccaagtccgggcgcagtgtttgtttgaggctgctgggattggccaaaaaggccacctcccccaagggtattgttattctgggtgccgcttccaaacaggccaccattagttgttgatccttgtggcttactgccaaataggcctcccgtagtcgctgtagtattctgaggctttgcaccaaaaagtccgcctgcattcatgttagatgtgttttgagtgctattgccgcccatcagtgagccagtggatcctactttattaccaaataaacccccacttgtggtactattgttttgtgcactgttgccgaaaagacctcccgttgtggtagttggcttgtttccaaataacccacctccaatggtggattgttgaggttgtgctgtttgttgcccaaataaacctgttccagtagctgtagttcctgaagcggtagtgcttgaacttcctaggctgccaagagcaggcttattaccgaaaaggcctccacctgtactactttgttggttacttccaaaagtatttgtggcctgatttgcaccaaaccctccggtagtagccgtcccagaatttggctggctgcccccaaaaccaaatcctgaagccgaaggttgagtatttgtattgttattgttttgtccaaatgaaaaaccggtcgaaccagctggtttatttccgaacccgttattactaccgctgaaaccaaacatgtgatcaattggtcaacaaggtatgtcttttgttactaacgagcgtttctggaatagtttgaacgggataatcctcgatttagtctttcagtccctttggcaaaaagttgtttacatcgacttggagagttggacttttgcttttactcatttcaagaaacaaaatttttgaaaataatccatttcgcgtacgttcaaaatgatataattacacattggcaacaattatttagattatatcacgtagctattgtactattttcctatgagagaactgctgtagccatgtgggatgatcatgcgggcaaaactaaaatacttatatcagtccacaattgaagtatggaaagttttctcccaactatgccgtttttataatggagactaatgtcaaagataggttttgcaggcttgatgggttttcaagacacttttcggtcaagattttcagtgagatttgaaattcttgcagaaggtcttgatagtcattgcgcagatgatgaatatatggtgaattggaatcagcacaagactccaatattcgacgagatgccgtaatcaacttatacaactgctcaatcaggccagagcaaatttcttcttctaatggttctataccgcacatttcatggagagatttactcaatctctttccaagtgagagcgcttctgtcaattgtgaatggttacgcagagagccgtaaatctcatctaacttctttaggtattccaggacatcctttataatttcttgtgtattgctgatgtcatcctttatcaaatgatctaattgagtcataaatttttgaagatcactttgtgttttctctaaatttattagagtttcattttcttcatctgtataggtattggaaaaagtcagatagtcgtcgtagttacttcttatttgttctaataatgtttgtaccattttttgtgaaagtccagacaaatctctaataagggaatcgagaggaaggtaatggaaatttttctgcactaggaatctgtcgacatcaaagttatcaacatcggtcccattagtctcggattcacgatacttctctatttctgttgcgaataactctttcgatatttctgcggttaccggtaaatctaagtctagttcatcatcattcaaaaagtccatttcgccctgagagaaattgcgactatgactgttgaccattcccttttcatattatttattattctatattttttctaagcttcattttcttgtcctgttgaaaattccatgaaatcgaggtaaaggcccgagcaataataattttaatttaaataaggcaccctcataaaaacggtcttacatcccattatacctaaatacgtattttttggatctagagtgttaactatttcacgattaccggttggtgtactcaaataattaaaatgttgaggactaagagagcctatattttctcgagaacatagtcaaaaagactccatggccaagttggttaaggcgtgcgactgttaatcgcaagatcgtgagttcaaccctcactggggtcgttttttgcttgaaatgagcaacattggaggaagatttgtgaaatcctccagttttctttttttcctctaggttttaacgaatgtgataaaagataactaaataggagggtcattaaaatgctaggtaacgtataaacaatgcacatctatacatatatgaaggtttgaataaggaataaataacacgtgctcataaaaaatcaagagagccaagctggaaacaaaatcaataaaccgtttacctattggcaggatcttcttgatgaattggtaggatcttttcggattgaatcatttctccattcccatccgaggaactattagtaccgctactgctacgttcagcggccaaatgagcgttgttcacccggtgatttacatcagagcgttgtgaatcttcgtctacaccccatagatagtaatctcttctcacttccacataatcgtacgcaaattcgccaatttgatcttcgtccatacccgcctcctctgcctcttctgatattcttagcctcataccgggtatgtagccgagcacaaagcagattattgcagttacagcagcagtgtacccaatggatgcggcaatgtaagcgatctgcttatacatttgcttgtaattgtgagttacccagccgccctcgtgctctgtagtgccatccataccaatgacccagtctgctccaaaaagggcattgaaaattagtcctattacgcctgcaaccccgtgctcagctagaatgtccatggcatcatctactttagcgtagtatttcaacttcgtcgcaaagttacacactacccccgccacaatgccttgaataagtgaaccgtaaagggttatacagcctgagcttggcgttgcagccaccagcccagaaatgataccggagcacagaccaactgtcgaccatttcttctccgatctgtaatccagaagacaccacgtcatcccaccagtaatggcactgagacatgtattcatgaatgcataaactgacctcaaatttggggataatgaggatgcagaattaaatagcagccagccaaaccacagtatggatgtgcctagagtgaccaatgaaacattatgaggcctgaaatttatcagtaacttttcatttcttttgcccaaaaaccaagagtaaacaaacccggaaacagcgcttaatatttcaatgttgccgccgcctgcccaatcgaggactccccattggtatgcccaaccacctggtgaccaaatccaatacgtcactggacaatatccaatggtagctagaataaagagaaaaaccatgtgcggtagcagcctgcctctttcggcagtggcgccagcgataatacttaagttgacgcacgaaaacatcatttggaaggttgcatacgcgagctcagggtaggcatcttcatcgaatttttttccgtacacgtttctaaagccaaacgaatctagattcccaatgaatttattattcggagcggactttgaaaaagctagagagtaaccccagaaataccattgcagtataccgaccaaagtcgccattaatacaacccagattagtgctagtgcagacttccttcttgccaatccggagtacaagaatcccaatccgggcaccataaaaaatactagggcggcacctaatatcatgaaggccacagtggggccatcgtaggtttcagtcgttaaaggccctgtagttcgactctccatagtttctacagtataagaatccgtactgcagttatgtttactaaaataattctctgatcataagcctaaacaagttacaagagcgcctatataaataaactaccttttaagtatcttattctggaactgcattatcgactggtaagcagaaggtgctatagaagcctacaccacttttccgattttttttttttttttttcaggaaaaacatcttccatcaatactttgtcatttctttcttcttctcttctgtgcttacatagccataagatgtcacacaagggtgtctgtagcaattgtgaatcttatcgttatcgcaatctctgagatgtctcatccaataagaggggcgcgtgtccgcagagataagcaaccagggccttttcttttgcactcagcctgacaaagggaggggaggcgcaaaacaaagttcgtggcaaaggacaaccgtagaagagcatcgccatgttgattttgaagaatgtcaagacacaagtacaagttatggatgtgcatcgcaaagggaaaaaggggagtgggggaaagaaatacgtttgtccctaagtgctcttatgctcccttttgtgcttcagaggttcttgatcaattattaagaggggataactctatcgtatataacttttatcttaaaaatggttcaggtagtgtttatataggctcagtctttcttatctgaaaaaaaacagtacgggattttttgtgcgctcgaatagtgccgaactcaattacgggctgtggtaacacttgagatcttgtcttcccttacaaatagctctaggggtgttgcatgtagccgcagtaacatcttgaagaagtgtacacttttgaggggacgccattgtgttacgttctatgtattgaatagtatagttttcaattttcctgcgctgacgtaaaccggctgtaagaaaaaacgtataatcgagaactggttattcaaaggttgaactttaaagtgaaaagtagctctaacaaaataaatcatgcgtgagaatgcaatgtctacaaagaaacttccctataaattatctggcagcagcaaaataacaacttccatacctaatgatttaatcatactgcgaaataattgcataaattcactgaacagttcctcgtccaaagctgacagcattacatgtatagatacgtggctaaaatacacagagggtttgttaacccacaggtacgaagctaataatgacgccgctctcattgaagaggagatagcgattgcgttaatcaatgttgccgtattttatcaagacatcggtattgaaacattgtacagagcttatgaatcttcacaagcgtcaaataacttatggacaacaagcgggacctatctaaagagaggtctaggcttaatctgctttcttggaaagaattttcaaataaacacagctaatgattgccaaaagatgcaggttctcaacgtccttaatcagctatcattagagtttcaattgctgcaacaactagggattgtcgttttagcactgtctaaactaagatcaaaaatcagcaaggatgctgttgcggaccttgagcctcaagaattggaagagctaggcaagtccagtgtcttttacgctaagctttgtattggatcttatagcactgcttcgcaatgccaaggaggccgtatagtggacgcattatttatgaattatttacagagtttgacctatctcttcctatcaatcaaccaatacaacaatgatgagtgcggaattgccattgggatgctccaagaatcgatcaaaaaactgttaaatatagtacccaattcgcaactaaaagagttggacattttatcctcaaccgatattacaaagaagagggatcttataaagatgtcgtttaaaaggaaaatacatgggtctactttaaaaaaccaacggatatttgagaagaaggtgccattttcatccaaagcgtacatgatgccgttattgaaatcttcattagacgattttgttatcccactaacgatactgttaaggtacagataccagacaaccaatgagaattattccttcaaaacggttgaaaccgacgtttctaaattgaaggagcttttccccaggggaaaatcgtcagatattgaaggcactgtatggagtttccaagatggacatcttacatttgcagactcaaataatgcaacccacaattgcggtaattatttttgaattgaatcaaacgccgttcgaacgtagaggtcaatagtctatatgaataatatttttaaggtctactctactatgaattttgcataaaaatatacacatgttagaataaggaaaccactatctactaatcacggctaaccactgcaaacaatggcattatttactaatataattatgtgtgttggagtgagaatcaattatagtctaccgatctggtgctcttgtcagcagtatattatttttgagaagaactttcctttttttttatgtatacgtaatgatcagaattttttaataaagatgtacttcaaaagctttttttaatattcatagtagaatttagtgaataatttgataattgttgggcttccattgttggtaaaggctattatattagttttggaataaaaattcaactatcgtctatcaactagtagtcatactaccagtatattatcatatacggtgttagatggtgacataggttatgagaagctgtcatcgaagttagaggaagctgaagtgcaaggattgataatgtaataggataatgaaacatataaaaccgaatgagaaataatcgtaattgtattacatagggacaccaattccattttgaggattcctatatcctcgaggagaacttttagtatattttctgtactaatattatagcttttaccgataattgaatcctaacagtaatctcaaaattcaccaatttcccacaactatcgcaaaattcacccatattccaatcttgtgcgcttcatggcgattatttcattatgtttggttaataaaataaacataatcttgcattagagatagttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacacaagtgtaatttcaatagctcgcgtggcgtaatggcaacgcgtctgacttctaatcagaagattatgggttcgacccccatcgtgagtgttgtttttttaaataatttcctggctgaagggaataatgttgttcaacaacgaagatatttcttatttttctaagaggtattatgatatgatacatgacaataaacattatgaaattttttgtgaaagatgtataaatttaataaaaaaaaaaaaagttaacttcctccacttcgttagctcatattagtttcttttattcccagactttctgcttttgataataatctagcaaaatagaaaaggcatgactataaaccaaaaccaccattagaataggccattggttttatatctgggtgctcaacagcttcgaatgtctcaattattagattttggtcgtcattcctgccagcctgtaaaataccatggcctggtacaacatgaataacacccccaagattaccttggctatcacaatagtttggagcactgaaaactgtcattaatttacccttctgctcgaattgcacaccacccattcttaactcgtgagatctaaaaatcttgcgcaatttgttgtttcttagaaatctatctgtaatgtcgggtccaaaagcatgtcctaaaccacgctgagaaggacccatcccgttggcttcttgtgggtccgcccatagaagttccataaaggcgccatctctaggtggttgggcaaatctatcaatattcttgaaatcagacaaagttgctgaaggatcacttggtaaaccaccatgcattacaaggtaatcattattaattaaggtagccaatggaaggctctcaaaactttgtgcaaacatgttaaatatcctttgtgaatatttgtatttacactcatcttcaaacccatagattttgttcatattatcactctcatgattacctctgttcaaaaagaaattatttggatgtaatattttcaaacagtagaataatagtgcaacttcacacgaccaagaaccacggtcgacaaaatcaccattgaatagataagtgtgcttaggacctactttaccaaacttgcgaaataaattcaaaacatcataaaattggccatgcgtatcaccacatactgatatcttaacatcaggagtagagttattttctagttctaccatagatggctcttgacgaaataaggtatcagcatgagagataatagctgcaacgtacttttttggtaaatattttccctttaggaaaagatcgttaaccattttggaaataaactcttgagacatgttcttgatctttgcacctttaaaggcattcttatcgtcatacagctgttcaaattctaactttggaccttcataattggctaaatctgcattagcatcaaatgaactcaagttcaaagtctgacacaaactgatcttggcttcattttctgcgcctccgatagctttcctaaatctttcttctctaatgaacctatcacatgtaagtaacgccttagtagcagccggatcattgggcttcgcctttagaagcacattcaaatctttcctagcctttttaaattctagcagagccatgcaggataatgcacgtctatgataagctttgatatttttgggatccagtttaatggcttcatcacagtcatttaaagcgctttgaaagttatctaccttaaagtgagcaaatgctctgttcgaaaaatagatagactgtgtagaatctaaatcgatcgcctctgtatatttttcaatggcctttaaaaaatgtttttccttcacaaaaacatttccttcgttctttctttcaagtgccttcgcgcgatctgctgctgtgggtgttgacatattcgagatatttgattataccaaggcaagcgttatttcttgcctctaaaattgttaaagttctgtgtcaagctctataagctgttttcgccaattttcttacctcatctgtgaaatttttcagtttcccgccgtcgtttttttccctggtttagcgttttaacggaaaaagaaatacatacatacaatgattgaaaaaatattttcataaagaagaaaatgagaaggaacttttgaggactagaagtgttcctgataattgtctcagccagaattttcagtggccaaggtacgaacaagaaactgctaaaaggaaaaaaaatactcagaataacagaagatgacagacagtattgtggaaccccaacaattatctcaaaatttacctatttcttaagtataaacagtacactgcatcagtggtattagatttgtcatggtgtaaaattttatgataaaaaaatacaacatggcgggcgtaaaataaaatacatattcgtaatcctggaatattacgccaactacaaccaataacttatgattatattaccagaatattatcatgtatggctctcaaaatatgacataaatggtttctattaaaagcatcatcaattcaatgaagctgaaatttcaaggattggtgatgtaatagaacaatgagcggcgatatcatagaacgaaaaaagaagtaatcgtcattttttgtagcactcttatttccttttttagagttctaatcctcaaggtgaaaccgtaacatatgcatatacttaacgataccgccttctttgaaaattagaagccttatatctatttcgaacgcacatatgttgtcatacacaatgcgacacatgaaaatactactctttacacctgtattatcaaactattaatcagtgacttccgaaaaaaataggtctcttggcccagttggttaaggcaccgtgctaataacgcggggatcagcggttcgatcccgctagagaccatttactttttagaatgcaaatataagatcccgataaatcatagaaccaccacttacttattcacttatgtggtccttcctgctgtgggcagagagcgatttgcacgtacaaagcgatcaaattacgaacaaaacaatacataagaggtttggacacgttcttaaggctaactccacattgcgataacaagattaaagtgagctcctgctcattcctaattggaactcatcatgcctcccatcaaggtggagcctggattttactaaagaaaccgttcgaacggctctgtatttactaagagggggatatatcaaatcgtggaaaacatgagagaacagtctcgttgcgtgcaacagccgctatcctgctgctctctgcataactggaccttgcgtattgggttcattcttttggctttgtgaaacgattcacaaagccatacgtccgtagtatggaccctgcaggaatggtctacattttctatctactagtaaagctttattcacatatgggtgccgcacggcgcgggtttttgcaaattttcttagcattgactcatggcaagatttctccagaaaatcagtaaagcctcatccagcctctcttcttgaaaaaattatgactttgaatcgcatatttcaaagatttgccacttgcttagtttcatttattctaatttaacttttatactattttttttgcttcccagttaagctcaccaaaacacaaatactcactacaatacaatatgtgtggtatctttgcagccttcaagcatgaagatattcacaacttcaaaccaaaagctctacaactatctaaaaaaatcagacaccgtggcccagattggtcaggaaatgccgttatgaattccaccattttcgttcacgagaggttggctattgttggtttagactccggtgcccagccaatcacttcagctgatggcgaatatatgcttggcgttaatggtgagatctacaaccacatccaactaagggagatgtgctctgattacaagtttcaaactttcagtgactgtgaacccatcataccgttatatttggaacatgatatcgatgctccaaaatatctggacggtatgttcgcattttgtctgtatgattccaagaaagaccgtattgtcgctgcaagagaccctatcggtgttgtcactttatacatggggcgttcttctcagtctccagagaccgtttattttgcctccgaattaaaatgtctaactgacgtttgtgacagtatcatttcgttccctcctggtcatgtctacgattctgaaacggacaagattactcgttactttaccccagactggttggatgaaaagcgtatcccatccaccccagttgactaccatgctatcagacacagtttagaaaaggccgttagaaagaggctaatggctgaagttccatacggtgttcttctatccggtgggctggactcttctttgattgctgcgattgctgctcgtgaaacggaaaaagctaatgctgatgctaacgaagacaacaatgttgacgagaagcaacttgcaggtatcgatgaccaaggccatctacacacatccggttggtctcgtttgcattcgtttgcgattggtctaccaaatgcacctgatttacaagcggctagaaaagtcgccaaattcattggttctatccaccatgaacacacttttacattacaagaaggtttggatgctttggacgacgtgatctaccatttggaaacttacgacgttaccactatcagagcttctacaccaatgttcttactatctagaaagattaaggcccaaggtgtcaaaatggttctttctggtgaaggctcggacgaaatattcggtggctatctatatttcgcacaagcaccttctgctgcagaatttcacaccgaatctgtgcaacgtgtcaagaacttgcatttggcagattgtttgagagctaataagtccacgatggcttggggtctagaagctcgtgttcccttcttagacaaagactttttgcagctatgtatgaacattgatccaaatgaaaagatgatcaagccaaaggaaggacgtatcgaaaaatacattttaagaaaggcattcgacactacagatgaaccagatgttaagccatacctacctgaagaaatcttatggagacaaaaggaacaattttccgatggtgttggctactcatggattgacggcctaagagacactgctgaaagggccatttctgacgccatgtttgccaatccaaaggctgattggggcgacgatattccaaccaccaaagaagcttactggtacaggctgaagtttgatgcttggtttcctcaaaagactgcggcagacactgtcatgagatggattccaaaggccgattggggttgtgccgaagatccttcaggtagatacgccaaaatacacgaaaagcacgtcagtgcttaatacgagcgcaatcgtattcttataattgacgagtgaaccaagaaatgcggtgatacaaacggatattaatctatatagatatatgtatataataaaagttttcaatctgctgaccccttaggttacttatctataggattcgaattacgatatgaaaccctttcggtagatatcacatggaatactgcagccgattgattagttaatttcttatctcgctttttttctctttatctatctatctatctatttatctatctatccttatgctgcaaaatgaaaaattccctaggaagttcgcgctatcaaggttctttttcccacgtatcggtccctgagtggatcccaaaaaatgtgtgggactatgactatatatataacagtcacagttgaatcatattaatgttctatttcttgaggtgatttcaaattgtggctccaacaagtaatctcggcaagctatccctttttaaataatattttgcattctttttctttttttttttttttttttccatctcacagcccttctttattttttcaataaggtaacagagttgataaggaaccagataacaatcaaaaagaatcgtttcatttcagagctaccaccggtctataagcaagacagtttaaaatctcaaaaatttaatttagaaatatgggaaggactattaggagacgccggagtaattcgtcgctttcggaggccatatcagtttctttaggaataaatcaagactcatctgtgaacaagatgcatagagcgagtgttagcgcaatgtctcctccattatgccgttcatacatgagcggattttttactggtggnnnnnnnnnnnnnnnnnnnnnnnnnnnnnnnnnnnnnnnnnnnnncgaacaaacaacatcctaaagtgatacatggatcagaaaatttgcataggcagacagctcaactatccaatgaattttgctcctcttctgtggaagaaaattctcccacaattaaggattacatggacattataggcaatggtgatagaaaagatgatcaatctatgcgtactatagaagagaatattgatgaagaatattcagatgagtactccagattgctacttagcccagcatcgtctaacgtggacgatgaccgaaatcgaggactacagaatagttcactaccggaattagaagatggttacgcgggcggatatcagtcacttcgtccctcccataatttaaggtttaggccaagaaacttgtggcatatgtgtacgtcatttccttccaaatttgcacattatctgcccgcagcagtgttaggtttgcttttgaacattttagatgccttatcttatggtatgatcatttttccaatcacagagccagttttttctcatttagggcccactggtatatccatgttttatatttccaccataatatcacaagccgtgtactccggaggctggtcgagttttccttccgggattgggagtgaaatgattgaaattactccgttttatcatacaatggcattagctataaaagaggcattagcaggtaatgatgacgaaatcataacgacaacgatattttgttatgtgataagttcgatgctcacaggtgtcgttttctatgcattgggtaaactacgactaggaaagatagtgggattttttccacgacacatattgattggctgtattggaggtgttggttatttcttgataattacaggaattgaagtcacaacgagggtggcgaaatttgaatattcatggccttttttttcagggctgtttacggattatgacacattagcgaaatggttattacctgtactattgactgtagttttaatcggcactcaacgctactttaagaactcactcgttttgccaagtttttacatcttgacgttagttttgtttcattttattgttgcgatcattccaacattatccttggatgctttgagacaagctggatggatttttcctattgccaactcagatagtaaatggtatgaccattatagattatttaatgtccataaagttcattggtcactagttttgcaacaaataccaacgatgatggcattgacattttttggtatcctacatgttcctataaatgttcctgcgttggctatgtcactacaaatggataagtatgatgttgacagagaattgattgcacatggttattccaacttttttagtggattattaggttctgtccaaaattacttggtatataccaacagtgttctgtttattagggcgggcgctgattcgccattcgctgggttccttttaatagctttgactatctgtattatgatcattggaccagtcataatatcattcattccaatctgtatagtgggctctctaattttcctactaggctacgagttattagtggaagcgttggtcgatacatggaataaattgaatagattcgaatatttgactgttgtcattattgttttcacgatgggtatctttgattttgtcctaggtatcatcgttggcattttaattgcatgtttttcgtttttggtggatagtacgaaattacaaaccattaacggtgaatataatgggaacgtcgcaagaagtacagtatatcgtgattacgttcaaacaaaatttttggatggaattggtgaacaaatatatgttttaaagctccaaaaccttctgtttttcggaacaatcatatctattgaagagaaaattgaaagattgctgcaaataagtaacaaagatgcaacaaaacgcagaataaagtatttaatattggactttaaaaatattaatgccgacaatattgactattctgcggcagaaggtttcaatagaattaaaagattcacggaaaccaaaagaatcaaactaatcatatcttcaatcaaagaaagggaccgtatttacaacgccttcaataatgtgggattactaaacgatgtggaattatttgctgatttaaacagtgcgttggaatggtgtgaaaacgaattcctttttcaatataaacaattaagaaaaaaggcgaaagaaagattggaagaaggaaagcaaaataatgtcgtatccgcagtaattgcagccactaaaaacaaaaaaattgatacaataggaaatggtttaaacaggggaagcaatggagacacagcgagaaacttaatgtcactaccaaccaatactcctcgtaattaccaaatactttctgtagcacagaatgtatttgtaaacgacgaacaagcagtgaagaatttcaaaaaggagtacaaagatgatgaacctgtcctgcctatattgttatttgcattaaagcagtaccgacccgatataatatctgaagttcaaaaagtaagagaaaaggaaatcaagttttgggcacaactctgcccctacttcaccaggcgcagattagcaagtcaatcacatttactacatgcagacaacatttttttccttgtggaaacaggtatgttgaaggcaacatatgaactaccacaaggaaccttgtacgagattttttcaaatggcacatgcttcggaaaaatcattgcgccagggaatgctatgcctagagaacaaaagctcaccatcgaaactgaaactgattccgtattatgggttatagactctagctcgttgaacaaattgaaagaagacaatctagcattgtacgtggaggttgcattaatggtcatgtgtatcaaggacaccagattcaaagaattactaggttacacacttgttagcgcatgagagcgtacacgtatatttatttaatttcttttattgccggcgtattgcaagtaatttacaccagtactaaataaaagcaggatgctcctgcatctgtataagtgatgccgttgtaggatttttaccatctcgactataaactttttgtacttgagtcttcacttccggaattttactgcgcgattttctttgatagggcccctatcgtagacgaaaagtgataattcccatcgatgagcaactacatacctcacttgacttaattgctctcctaaagaaaaaaaataccgttacttttttcattaatatactaccacaacaattcacaacgggtagttgtacggttagtttatatccgcattaacaaatcaaagtcataacaacgtatcaacgtagactatgcctgtcccatctgttactgtcactaccgataatgaatatgaagacatatcgtccttttcttctattgactcttacaaaccggagccctttactgggttcaaagattctgaagctccagaacagcctcttttaaaaaacgataccattgttggaaaggggcaactggaagatgatagtaatgtagatgatcaacaccgtcattcagatgtgcattctcatcacagttctagtactttaaaaaggccaacttcaaattcgatagaaaagatggttacccacaatgctttagagggcaactcagaaacagttgattccttaaaagaagatggtttaaatttgaacaagaaagctcttccggatattaccgccccagtaacaaactcagctcacgatgctgcatttccagaagagtatcgtttagaaactgaaaccgggttggtcaaattgaagacgcttgaaagtttgaagagggaggactctcgcgtatcctcaactaaaaaagagcatattaacgaccatacagatatgcattcgacacgatccaaggttactacaaattctcaaggttcttctctagaaccaaacaagttgaacatggcagtagagaagaataagaagaggatcgaaaaatatcaaaaacataaatcagaaaaggggatcaaggggttttttcatagaattttcgattaagtggcatagcaacatttagttcgcaatgcgtttacttcagaatcattctttttttttttttttttttttttgcctcacattatattcttggcatctgcctagctttcgactttttcgttcaattcctaaagcgctaaaaaaatagtctccccctgaaagtggagtaggatagtagtatatgaagtgaggcagaaaaggaaagaaacgcttgcatttattaacacacctgtggctaaagtattaaaaaccaaaaactaacgaacaaataatgtgcattttaatggccacaagggcacatcctgactatgaactcatcttaatatctaacagagacgaattcttggcaagaaaaacacatgctacatgctggcataacaatgattttatcctttcaccctacgatctggccaaaacctcagcagaaaaacaaatatttggcacttggtctggcataaataaagaaggaaaattagccactattcttaatttaaaacttgacaatgagcaaaataatacgaaatcaagatcccgtggtctgttaccatttatatttttgtcgatccataaagcagattttgaagattgggataattacaaaaagtttgaaggtcactatgatgggttgaagtccacaggtgattttaattttttttacggcgacgttatcaaaaagcaatataaagttattgattctctaggaagaacttttgatgtgttgagttctacctgtaggaaagatcttgattcttacatggttgtttctaatggtaaattttatgacagctccagtataccagggcaggcttgggaaaaagtaaaggtagcacgtgatagtttagaaaatctagttttagagaatattgaatcagatgaggagaaaataatatcaagttgctttcaactcgcctcgaagtcttcccttccaagcactatttcaaacccagatgtcttgcagatggtagatccaaatgtaaccatgaataccatatacgtaccacctttacggaggcctcccagggatgacttaggtgcctcaattcctgatggtgattactacggaactcgctctcaaatagttttactcgtgagtaaggattcaacgagagttacctttatagaaagggtcctttatagctcagatgaagacgtgcgcaagtattcggtaacctcacctaaggaggaaaaaaggtttaaattcaaattgtaaaaatcacaatcttccattttatttcaaactagctttaaattccatcttcttcccctcagaacattccggtatctcttgttggacacatctaatgtatatgatgttttcaaattctaaatgcctgttagtttatcagtaaccacagtagacgctatatatattagttccttttctatataggtattatacaatacaatcaaattcattgcatactcaaatgtccaagtattccatggtgtaagtgggtaaggctcgcttctgagaagttccgttatcaaaggttgagctagcaaacccatgctgaaaacctttcgtatcaatcaaattccacaattcggtatttctttcagcaatctcaacttgtttgtcaatatataaggttaagttctccaatagagcaccttctaatgaaaatagcccgatagaatctagcacaagggacaagagttgaaatagctgcgtgctttggctagggttaaagcattctggtgagctgtcttcaccaccgcttgttatgaactcaatgaaattttgaacgtctaatttacttagtttcttcatttcttgtttaatggagtctctggtgaaatcctgcaaaatcctaaatgagatatcaagtaatagttccctgtttctgatagaaaacaattcttcaagtagttcatttaatggcaagtttgggcatgttacaattgcttgtttaaataatctaggttggtctcttagtaaggatagcaagttgcgtgtacgactcaatggaaacaatgggtgtgtcaataaaaacgttaaagtttttggataatcatttccgctaaactttccgaaaattagatctaaaactttattcaaaaagccaggatcagaaatatatctatctttttcagtataatgttcttctttgatttttagttctttgaaaaatatgtcatcaaatgatgtaatgtcattatcttgaagggctgaaagcttttcaataacttcattacagtggaggactggaacgcttgaatccccgctgacgtcgttacatttcactctcttgtcatttatgtctttatcatcaaatagcggctttaaaataactgagctatcattatttccaacttgaaaactcttgcctaatgagtccttcaacgtattagttccaacatcaatattaattatttctaaggaagacgttgggtttggtccatttttcgttgaaataccaattgctattgtttttgaattatgcgacttttctgaattgatcactgcagattttaatagttggaatgttttcacgtgagttaattctctttggcttaaagtagaacaatgcagtaagtctagtagataaatgacgttgtttacggtcagtagaactctgtttactgaaacaggttggaaagagattaagtcatctccaggactgagtttatccaccatcggaaattcaataacttgttgcaattggcaatgtggtaaagagtaaatgtatattttcccctggttcaatttgtaaagttttccaaattgataacaaagctttgaattttcaaaagaaaatccttcgatgatagtagatgataattcttttatgggcgaactttctccactgccacaatctgttagctcgagcaatttatagcagactttatcatcctgtaatggacagagaacaaaaacatattcagttccattttcagtgaaccatttagcatattttaagttatcataagatatatcaaatgaatgcaaaagtgttaacttaaaatcaaaaatttcaatcaacccgttctgtaaaattgcaattactaagctgttcttggtgtcaattttaatactcatgactttggctttcgccttgatcttatactgagataaaaattcgtctgaacccgtgtatgctttattgtcaatatcactctcactcagatggtcatttgaggtatcagtggtatcttccagtgccttagtgataacatttagcgtataattacccttatttaccattaaaccaaaggcccaaatttcaacatttctttttttttgggtgttgatagtcttctcgttgttggcttcatcatcggtactggcttctatatttccgtcaatgttcgcttgacctttctcagcattgcatgccgtgataatatttgtagagggtattgggtaatcgaatgttaactttggtgtaggattaataatatattgagatatagatgacccggaaatacctaacgttatgttatttgtagattcattaaaggtgccatctgcgacttgaacgtaatctgcttgtaaagaaaaattgctcaatgaagcaatttttgggagagttgctagtctaaatggttgagacagggatggcattttgaatctttactatcctccggaatgatttgctgttcaaggagcgctaggtgtgacatataatattacaaatttaacagtgacctcatctcatcaaagttttcaaatttttcaggcatctgctacagcataatgaaaaaatttgaaaaatacagacatttccgtgtagaatgacaaaaaagctagaatattactatattttccttaaaagagcaatatttgcgatgaggggctctcaatgacaatgtttgacttctctattgaactgtaagcgaagcaaaaccatatcttgtcaaagtattcgaagaatggatttttacaaattagacgagaagctgaaggagttgaaaaggaaaagagtagatgtatctataaagagtaggaagttggctgacagagagattcaggaagtaagcgcaaatcgaaaaccaagagtatacagtatggaagacgtaaatgatgcagatgaatcagtaggagatacagaaagtcctgaaaaagagaaagcatttcattacactgtccaagaatatgatgcgtgggaacgtaggcatcctcaagggaagactgggcaaagccaaagaggtggaatttcctatgatcaacttgcaaaattgagttatgagaagaccttgcggaatctcgctacgcaaacacagaattcgagcaaacaggatagttccgccgatgaagaagacaataaaaacgtacccaagaagggtagaatcggcaaggtacagaaggacactaagacgggtaagataacaattgcagatgacgacaagctagttaataagttggccgtttctttgcaatctgagtcgaaaaaaagatacgaagcaagaaaaagacaaatgcaaaatgcaaaaacactgtatggggttgaaagcttcattaatgacaaaaataaacaattcaatgaaaaattgagcagggaatcaaaaggatcagaataagcttctcttttatttagaatataccgatataaccaaaggaaagttttaataccctggatttttcatcgaccgtcacgtgacgagctgaggttaaatgcccgcaaaagtgcttcagaagagagtccatcttactcggttatttgagcacgaaacactagagaataactaactggttgataaattgttgattgagtaaatattggtacataaaacggttacaaagagaggtagattaggaagggtgaaaataatcaaaggataacttgatgatactcgacaaagaatagaagagaaaaataaaatagaggtgggatattccttgaacaaaagtggaatattattttttttaggcatacatgacgtcttcctcagtatgatattcatacaaggaatcgtcctttggaaggacgctcgtattcttttgtgaacggtcatttggtattttgtggttttcagccgcgtgtataccttcagcttgtttgtgctgcctactcaatatttcttgcttcaaggcctcatcagcgtttttctggcgagtttgttcctcgatagccttttcagcttgtaatcgcgttctttccctcttgactgcctccagttctttctcttcggttgccagcttatcctgtagttcagtcaattggtcattataggtttgcttgacttgagtaatttgctgctcatgatctaattgagcctgatgcgcttgttcctccagctcttggcgctgtttttccaataagttctcttctttgcgttttctttcttcagcttctagcttcaactgttcttcatgagcgcggcgctcatcttcgagtcttttggtaattgccgatagttgagttttttcattggcgttttcctgcttgattatggtcacttcgttcaataagcttgatatttgattatcaatatcattaatttgtggaagatattccttgttctctacactttccaaaacttgtacatttttttcatgcagcttcttattttcttcagtttgggtaaccaaatcctcctttttcttttccagattatcgatttcgttttgaactttgccttgtttcaaattaatctggttaatcttaaagatctgagcatccaactgttgagataagttacttaagttcgtggtccagtcattgaactccttttggacattcgttttctcattgttcaaatcatcgatttctgacttaacgttggtttgtttgtccaagacctcatttttctcctgcaacttttggtttttcatattttcagtgtcttttaatatcattagtttcttattattatgctcggcattaacatcaatgatttttttgaccaaccggtttttactaacttcaattttctcagaagtttcttctctcatggccttcattgaattttcaatttcgtcaatctgattttgtaaatcttgtagcttttctttgtattctttatttttagcatcatatttatccttttcctttgctcgaagatcagctaaccatgcttgatgaattttttcatcataattgattttatcataaactgcctttgataggtaaccatgttcttttgtctttacaattaattcaggattttctggagtggccactggattggatggagcggcggtcttacttttttgggtagatgaagaagtagggcttttccataaagcgaaaattccggttctttcctttcgagaaggttcctgaaaagggaccttgggagccttgcttggatcgattgggctttcatcttcttcggattccggttccgaggtttctggagtagacgttctctcagcagattcctctgcagacgattgttcggtttcctcttctgcatccccttccgcttccacttcctttttttcttccccactgggaggattgactttttttacatcggatttttcctccttttgttcgtctgttggcacgacacctgactttgaaccgccactttgatctgtagtgcgtggttccaacaccccattctcggatgagattggttccgctacattaatttgagctgaatcagcagtgcctttgccaattgaagtagactcactcactttgtcttcatgttcttcctccacggaagttgcttcatcagcactattttcgacagcattagtagtagaagtgctggtagtagaagtactggtggtagtggttgtcgtagttgcagtgtcagcagttgcttcagtggcctcagatgtggtagtagaagtaacgtccccttcatctgatgaagacgatgacgatgacgatgacgatgacgatgacgatgatgatgtagaagtggacgaagaagtagtagtgtcagtgtcatctttttcatccttagttaagtcagtaattttctggcacttcttcaaatatttcaaatgtttctcctttagttccaactcagttagtaactgatattgtctttcttcattttgagttaggtaagttggaaatctaatatctttggctctcttagcattttttggtatgtttttgtaccctaaatccttaggttgctgttttgaataggcagaagtagcacttacggtaggaaactttctgttttttgcgtcttccccatatgcccggttgttttgcctattggcgagggcatcttgtctaaatggcgagacccactcttccttaccttttggctcattggacacaaccttttgcaaaaactgataagggctttcctgctgatgcgcttgctgattttgcgtatttgccgaagattgattgatcaattgcgtaaaggggtcgtcttcttgacggttgatattgaatagcatgttttgaatacgtagttgattgacctctttcttttaattgcgtgcagctgctctcaggtttaagatgtacgagggtccacggggtagcaagcacaagaacgatgatatatatgacagaacgatggataagaatggtatgttgtctgcactgttcagcattcgactacccctctcccggttcttttctcctcgtttcaatttaaaaaagcaactcgctacccggccgcacaccccttattcctgttcagccgtttaaggtgagaaccctttacttcatagcctttgtagatctttctattgctaccattgaagggtcggtgacgtggaaattttgacatttatcagtggcgtattgggaggcaagcaattgaaagaactgtgatttatttccgcttgttcgaaattattgatgtttagcactttgcagtagcgacaatacaatatatgtgcttttagtgctgggatagttcgtagctccatttcggggcgcttgttacatttattgtatatgcgcggatgtggcacatgctgttgagatctcactcctttggtatctctttcctgcgccgcattgtgccggcagaatgtcgcgcttgtattctcatgaacttttcctctttacgaaccctttggcggcatgccgtttaaaatctgttgaagatttcctttacgaacaatgagcaatgttttgcacaggcaggtgggaagtagggcctatcgcgccttggatgcagatataagtataaatataaattataataattggctgtatcagtaaatccttcttgcgatgggaggaagcacgatagagtatgttaagcttttgagaggcttcatattcattggaattttaaataacaataaagcaacaacaataataaatgctatcagctgcagataatttagtgcgcatcataaatgctgtttttcttattatatccataggtctaatcagcggcctgataggtacacagacaaagcatagttctcgagtgaacttttgtatgtttgccgccgtttatggtctggttacggattcattatatgggtttttggctaatttctggacatcattaacatacccagcaattttgcttgttttggattttttaaatttcatatttacgtttgtagcagccaccgctttggctgtaggtataagatgccattcgtgtaaaaacaaaacatatctggaacagaataagatcatacaaggctcaagctccagatgtcatcaatctcaggctgctgttgcgtttttttacttttcctgttttctattcctcatcaaagtgactgtggccacgatgggtatgatgcaaaatggtggatttggctctaataccggattcagcagaaggagggcaagaagacaaatgggcatacctacaatttcccaggtttaagcctactggactgaaaaaaaggcaattcgcgtacaattttcgttgatcgttctttatataacctttgcattaaataaatttaacaaaaaaagttctttctaaaataatattatggtgatacatgaatgtgctttagttttttcgtaggctcatccatgtatatatataaatgataaaaaactaagttacgatattgatagcatacgtattcgtgttggtaactaaatggaaagatggaatatgttattggcgttgttatcccccatatatacaggtttctaatatgattaaaaaaaaattttctcccctagtttattgtgttcatagcttttccagacttaacggccaatgttcaaaagcaaggaatttggtgatcccgaagactcgctgttaccaccaccagaatgttgacttggtaaatagacaacgttagatgagtttgctaatgtttgagcgatgtccttagaagcttctaatcttctaatcaataacagaccatcaccaactttagctaaggcttttgaaatgaattcagcactttctgcttcaccttcagctctgataacagaagcttgtctctcttgctctgccttttcgacaaggaatttggctctttcggcatcttgctgtgcaatctgcttctgctcaactgctttcgtgaattcgggaccaaacgtcatatgagtgatagagacatcttccaacttaataccgaattcgttggccctcgtagaaagctcttttctgattttttgagaaataatttctctctgagtaattaactcagcagcatcaaattgagctactatagactttaaaacctcattgccgatagatggtaacactctttcgtcgtaatcgagacccaaattttggtatattgcgggtagctgtaagacctctggtctatgtaagactctcaaggtcaatgacaccatttgcaaatccttcgtaccagtattggtagcaatgctctttggtttcgtcctcacatcgtatatgatcgccttctgtagccaaggcaccaagaaatgagtgccttcacccacaacctgttgctttacaccattgattctgtcgaaaataacaccacgagaaccacccttcacatcatacatggagtactgaatcccgctagcaattataccaatgggcaacgccaccttggtgatgacatcgataagtttggcagaattagacattcttttctaaagtaaattattgattttgaatgtaagtttcgtaccgttgatggttggtttaccgatttattttttttcctcttctttctgcttaatattatatacctcaaccgttgcatccatgagatcgtcaaactccctttccctgaaatttattgatgcgatacattcgcgttacccgtatcatcatgaagacgagtttattctcatcagtgttgatctctcatacttgaataactcatttgcaatggtctaagactccaactatgtagtcatagtcattcactgaagtttctcttttcgaaatcctgaacggaagcggaatatatgtggtatatatcgcatattactgcttcacagcatgcagcgcagactggccgggttatgctgccacttactggagacaacataaaatatacataatcatcgcctttatacataatatgccaaacttctggattcttgagaatcgtaggagctatacgtctgatacatgtatgtcgaggatcgtgaaggagtacaaagtcatactgaaaacattggccagtgatgaccccatagcgaacccctaccgggggataatcgagtcacttaacccgattgacgaaaccgacttgagcaagtgggaagctataatttctgggccgtcagacacaccttatgaaaatcatcagtttcgaatactaatagaagtccctagttcctaccccatgaatccaccaaagataagttttatgcagaacaatattttgcactgcaatgttaaatcagccacaggagaaatatgtctgaacatccttaaaccagaggagtggactcctgtatgggatttgttacactgtgttcatgctgtttggagactcctaagggaacccgtttgtgattctccacttgacgtagacattggtaatatcatccgctgtggcgatatgagtgcctatcaggggattgtaaagtacttcctagcagaaagagagcggatcaacaaccattgataccacgtaggatggatgtgttcgaatggcaaacaatgggccctcacttttatctgatgcaatttctaccttacccgggcagcgccaatttatgaatacaaatactttaacaaattgcactattgatgtattgacacatttgtatatacatatacatatattaataaggagcacgaatttttgacaagtagtgcacgcaatatctacattagttagcttttccattgacgctgaattttattttggcagcccagtagatcgttgaggagcttttttcaaacactttttctctcttaactccacatacttacgtaagaaagtgatgacgaaaaagaaagcagctactaattatgctgaaaggcaaaatttagccagtgaagattcttcaggtgattcggttcattttaaggactttattcccttacaagagttactgaaagataaaaattatgttccatcggtggaaaatttggagaagatcttatataatgaaaccatgtttaatgatcagaaaatatgctctaacctattgcttgaggctctcataattacgttgttcacaacaatttcagggaagtcagctttacgattaattcagacttcttctttgaaggaaagaaaatcctgggcccagtcctttgaaaataacagttctagctatgcttccatagtactgagttggaaagataatgatatattactcctgaaattcttaaggtttttattagcaaataaaacggcccctcttcaaattaatcggtacaatcttccagaatacaaactcccgttgagctttttaattgtttcaaaaattactattccgtccatattactcaatgaaacgtataatttgttaaaggactatttgtattcgataactggccgtatagagagtttgataagctgcagctccacatttgataagccagcacttgtcgttagaaaaattttaaaagattacaatagaatgatagaatgccgaaatttttatttctggtattcctttaatgctgagaacagagtaaatcttacttttagtgataacattagcctgttaatggaaaatgatgaaggcaatgctggaagtggccttgacgatagccgttttgatcatcaaaaacaaccgagagaggcgataatgggccgaacaataaatgaccaggaacaaatatattcattcgaactgaaccaagatggaacgcttgaaatacccaacgttatggagcattctttactaagacacgagcttctttttaaaatattaaatctcactacggtattgacgccattattggaactacaattttctacgctatgtggcttagtagatccattaatgcagcctactcccaatgataagcatattatatcgatagactttctttttcagctttttttgggattaatgtctcagtcgatcaagacttctcaagaacacaacgaccattatgactggaaattttatatgtgttttaacatgcaaaaaattattgatgctaccatgttgaggctcaactgctttgattttgatatattaaactcggtaaacaatacagataatgcagttcattggaagacgcaacttcacagatggctaccgcatggcctgaatacacaagacttggaattactctatatgattgatatactggcggtatataccatctacaagttgtatgaaaaaatacctatacaactaaacccatttttattttcattaatatccttatggaaaaacctctcctgtgttatacttttagccttagaaattgatagaattgaagaggagaatggcacttacgaaacgccgcttatggttcgcgccacaattcgtggagccgcagcattgaggtctgtaatagctaccgttctcaatggattagtgaaaaataatgatcatgatttcaagcacgagtctttaaacacattcatgtcgccctatggaagaaaattgtgtcatggtgctttatatgccgatttaaggtcacatactgcatctctacttgcgcttggagcaagcatcgaagatgtaacagatttatttgccgatttacagtcaggtgatagatttgatgaggatattagatatatgtttgattatgaatgtgaagattatgatgaatctttctctgaaagcgatcatggaggattggatgaaagcgttgttaacccaacagaaaaaatagcatctggtagtaataatgttttctttcggagacggtgcaattgcatcttcaatgatgataagttggtggcagaggatggtgcaaatgaagcctttgggtcaacaaatagcgaaaacgttgaaggcgcaatgcataataataggaatgcggtacataacgcgactacagccacttctgatcacgtcgttacgtcacctaacccactttccgttagatcaagaagtacttttgaatttgactatagtggggaagattggagggacgttcccagagatttcaatatgtactattcgccatcttattcattcatccatgagcctaagttagatgtcatatttagtttgactctacgtggcgcaacagaaaagttgaataaggaggaatccatattgttagtgcgttcagttgcatcgtgtgtaaggaacgagcaggaccaaatgattttagcagacctggagtctaatttttccgcaagtataaacggcgatgtagaaggtgaaggaaataccaaaatgtccaagatagataatgaagatctcagaagaaccacgccggatgatatttatgaaatatggtctgaagaatcagcatttgaaaggatgctaaacgtgaatcacgacgttgcgtggagattaatggatgaaatgttaatgtgcaccggttataggagaatattgatatggttccttacgcatttggagttaaaacattcgttgatatattacgtttttgaactaataatggggttacgtggaaaaccgttttccggagaagccagtgatcaagataaaaaggatgatatgatatatgagatcttgaagaaaaagcagaagaatgaagatgcttcaggacttcccttttcaaggcaaggacctatcgtattatctgatattgagactaaaatgttactgcaggagttttttatgaatgctgctatttttttgtcatcaaaaaataacgaagaagagaatgaagacggcgagaaaatctccttgtactcccttggtttggttaggttgatctgttacatggtgcagacactcatcgcgaacgacaagtttttttttaccaaatcagaatgcacttttgagcttcaaactttactgatgacatggattggcatccttcctgaagccaaagatttattctttaagatcaagacaaggctcgccatggaagaagaggatagtgccgatactatgcagcatgagggcaggaagaactctgacatagagaagaagctaaacgctaagccagcttctgaactgaatctgaaattgttaaacctgtttccctcaaagcctgcaaacaaagacgatagttcccctattaacacgttgcgtagttttatcgctgattactccttcgacacccaggtgaaccctccaggaagaagggtggtgttctacgatggtaagattttgccattgcccaaagccgataagcctatcccacttcatgaatatataacactcgcagagctcgatgttggagacagtgagtgagcagtgaattgctcatgttttctctgcatcctcatttaatgacaattagccatgtaataacatcttgaggcagttaaatattcgttaccctgcaggtggcaaaaaatttatagaataaaagcataaaaagatggatatctatgtaataaggaaacattggcagagcgaagagaacagactgctttctataaaaagttttcgatcagtctctattttaataattgattattggatatagttagtagtgttaaacatgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataaggttggaaagtattgtttgacttcatgcttatataaatatgtacgcatagaaacatatctctaaaattaaaagtgaaagaaaaaaatcgctaagattcccctttcgggggaaggctgaagaaacttttttttgcgcaaatttcaagatcggaatcgctcgagaggcaaatataaaaaagggcctgctcgtttggcctacttgttgttggattctaactccaatctaattttggcagcacttcaaaaataaacaaaagcgatgtctgcgtcactagtgaatcgatcattgaaaaatataaggaatgaattagaatttttgaaggaatcaaacgtcatatcaggcgacattttcgaattaatcaatagcaagttacctgagaaatgggatggaaaccaaagatcgccccaaaatgcagatacagaagagtacgttgaagctttatatgattttgaagctcaacaagatggagatttgtcattgaaaacaggtgataaaatacaagttttagagaagatttctccagattggtatagaggcaagtcaaataataagatcggaatattccctgcaaattatgtgaaacctgctttcacgagatcagcctcacctaaatctgcggaagctgcttcaagctcgactgtttctcgtcccagtgttccacctccatcatacgaaccagccgcatcacagtatccttcacagcaggtttcagcaccttatgcacctccagccggttatatgcaagctccgcctccacagcaacagcaggcgcctttaccatatcctccacctttcactaattactatcaacagcctcagcaacagtacgcaccaccttcacagcaagcaccggtggaagcacaaccgcaacagagcagtggggctagtagtgccttcaagagttttggtagcaaattgggaaatgctgctatatttggcgctggttctgctattggtagtgatattgtcaacagcattttttagtattctgtcacgaaatatttgtttcagtgatttaaacttacccaatgattttcgtagcttgaaagagagaaaaactcatacagaatacggatatgtgatggttgcttaacgtaaagagctccagcaggatttttgagttgcataatgtcaattagcgtgttgattatcccgcgcttgaaattattatgtagtacactatagatgtatgtacacacatatacatggaataaaaagttaaatgtgatactgagaacattatttgaaaacaagagacattggccacgaggagtgtagcggcaattacaataatgttaaaatttaaaggtgcaactgtgtcgtcttcgaataagcaggctttatgtgagaaataacggtgtatgacttcaggaagagtagcaagagcgatcttgatattcagaagctgcaaaacaataatactttgatatttcgttaaagagtatgtagaaatgtccgacgtttttttgagaagttcctaatataaaatattaaaaattaatttttcagaatatatgtggaaatttgttatttttgtatcgtatatatgaatgactagaacatcattatttttaccggaaacttgcaccagcttacatctcaacactgtcgatggaatagtccttcttggacaacttatgtctcaagcccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcaattgcagcaaatggagcaccgatcttagcacctagcaaacgatcttcaggagtaggtttacgctgtttgacaatttgtaaatatttgttttcacagtagaaagttgtggctaacgcccaaagagcaccgataacaataggaataaacattaaacccacaaggttatctttgtagccatatagttcaccgaaaatgacagggaaggcaaagaagaacgcatatagtagagagtaaatcaaacacacgtagaaacaagtggcaactagaacaggttcagtgacagcgaagtacaaaggtctcaacagacaagccctcatcatttcactnnnnnnnnnncatactgacaccttgcgcttcctgctcagtcataatcttgggattaccagtttcctttcttaatctagcagcctttctcttcaagataactggagcgtacgtttctgggatggcagaagatatgatccacataacacctgcaaaggccatattgacccagaaaatcaggtccatacgtccggtagaaacggaaataaaaccgttaactagtggaccaacaacgggaccaacgtaaggagcaaaagcgaagaaagcaatagccttacctcttgtttcacttgggaacatatcggcaatagacccaccaactaaacacaaaccagatgatgaccaaacaccacataaaaatctacaagctaaaagacaacctagatttggagctaaggcgcaagggatattgaagatgacataaagacccatagaaacaaagtaagcaactcttctaccgtaaagatcactaacaggagaccaaatcaaaggacccagcgagaacccaataaccattaaagaacatgataaaatagcggcttccatacctacatggtatttcttttnnnnnnnnnncaacggttcccaacccaccactgatacaagcagaaccgtaggcaacgcaaataactaagatggacaacaggacagtgtaactccaacgaacccatgagggccaattgtgagggttttctggatcaccagtaacaaaagtaacgaattcgatctctggatctagctcgttttcaccgctctggtcttcacgttcttcagtttcttcctcttccatttcttctttacctgtggatgaggaattggtagcggtacggttcaattgctttgttctagtacgagataaggcagaggcggttctacccatagattgtaaggtagccactggaaccagcccagatggtgtttccatggtatattcttcagggaaaatgttattcttagcagtttgtggcgcattgatatcaggcactggggcggctgaagtgacacctaaatcttgtaaagacttgacggtctcagtcttagttaacttaagttgatttgcacgagagttggtttttgaggggacatactgttgaggttgttggccctcaacgtccaccatggaagtgttttgtgagttgaatgaaacaacagattcttgatcactcatatttgttttgtgtattatttttgtgattagttattagatggaattaaaggaaaatatcaatggaacaaaaatattaggtagtagaannnnnnnnnnnnnnnnnnnnnnnnnnnnnnnnnnnnnnnnnnnnnnnnnnnnnnnnnnnnnnnnnnnttaaaattcaaaccgaaaaaaaaaaaattaaaatattaaacttgatatagtaggagaaggaagttgtatattgttctctataaacacaaacaataaaatgatatatttgttttcttatttcttcttgatgtcttcaggaaaaaagaacataaacaaatacaaaaaaatcctagtacgaaacctcaaaagggtgtatgcgcaatgtatatatatagcaagaaaaaaaaataaacagtggcattacagtgcatgcggatggcagtgttcttcggtggctttttcgaaaaacctagaatgcgtttaaaagactcagacacctaagcagaatatgcgaatgactcgttcagtaaaatgcgacgcgacagtttgttttcgttctgcgctgctgtgttctctattcttttgagatgaatttaacggctatggaatcatctcgagaaatcggttctagtaaggcaccaagacattatgtccctcgggaggagaagggcgcacgcgtcaggcttccacgacgtccgccgtgcatgcgctctcgcatttttaaggtttagtgcggcaggcgactgcgctgcggccagcccgtgagaccacccgagggaatttgagtaagcgcgcccattgcggggtttttgcggtttgcgctgttttccgcacgaggtttctccggacacagttaagcagtatatttcactcggaagcgccggaaaatttttttaagcgcaaatatattcaggtaagcagcaaaaaaatactttttccggtggcccgtgatgtgtttgtaacagcttctgcggtactttgggcggctaaatggcaaatagatcaggggaagggtttttgcataggtacaaaataaccggattttgggtaagattcgatcttcggcacttgtggcgaagtaaaagtgttgaaaaagttcgcgtaataatagtgttagccgtttcagcttcgtccataaagtacatatccacaactctcatggtgcgaagtacaaacattgaacggcagctgtcttgctcagctagtggtatgtaagcagccgcattctatttttattttcgtgcctttaagtgttaaaacctgaggcagattttttatttttttgcattccccttcctttttgccgtaatggcgcattcagtgctgatatatttatacttcaatggtgcttctccttacttttcttatagaaataaacatcaaaacatgaacctcaaattcatccgaaaatgactgcggccactcaccttgcttcttccccacaaatatttgtgttctctgctttctttgtgtgtactttgtcttgctctatataactttctctctgctgctgagtcttcaaataggtagattgatgcctgtggacttttatacaaaggagtttgagtgattacattcaagataaacgtgaaaagttattattatatcttatgctaaacaacagtgtaattgcgtttgttaagcacaatctcaaaataatgcgctaacagtggtgcgcatactgccatttgttatgggctataatcggatagtgtattcttcttgtttggttatgtatctcaacatccaggtatccgttaccccactttgataccaggaacctttcgcgttttctctcgcttttatttttttaccgcatacaaacaaacaagaaaaagtagaaaacatatgagatcatcgattttgtttctactaaaattgatgaaaattatggatgttcagcaacagcaagaagctatgtcatcagaagataggtttcaggaactggtggactccctaaagccaagaactgcgcatcagtacaagacctactatactaagtacatacaatggtgtcagctcaatcaaattataccgacaccggaggacaattctgtaaatagcgtcccctataaagacctgccaatatctgctgaactgatacattggtttttgttagatacattaataaccgatgataagcctggagagaaaagagaagagactgaagatcttgatgaggaggaggagaattcattcaagatcgctacgttgaagaaaattataggcagtctcaattttttgtcaaaattgtgcaaagttcatgaaaatccaaatgctaatatagacacaaaatacctggagtcagtcaccaagcttcatacccattggatagattcacaaaaggcaatcaccactaatgaaacaaataacacaaatactcaagtgctgtgtccaccattattgaaagtgtctttgaatttatggaacccagaaactaaccatctctctgagaaattttttaaaacctgttctgaaaaattaagattcctggtggattttcaattaagaagttatttgaacctttcatttgaagaaagatcaaagatacgatttggttccctcaagctcggtaaaagggacagagacgctataatttatcataaagtaactcattcggcggaaaaaaaagatacgccgggccaccatcaactccttgcattattaccccaagattgtccatttatctgccctcaaactacattagctgcatatttgtatttaaggttctatggtataccatctgtttcgaaaggggatggctttcccaatttgaacgctgatgaaaatggctcacttttacaagatattcccatactaagaggcaaatcactgacaacttatcccagagaggaaacatttagtaattattatacaaccgtgtttaggtattgccacttaccttataaaagaagagaatatttcaacaaatgtaaccttgtttactcaacttgggatgaagacacttttagaacatttttcaatgaagaaaaccatggaaattggttagaacaacctgaggcctttgcgttccctgacaaaataccgttcgacttcaagaaaatcatgaacttcaaatcgccctacacttcgtattctacaaacgctaaaaaggacccttttccgcctccaaaggatttattagttcaaatatttccggagattgatgaatataaaagacatgattatgaaggtttgtctcagaattcaagggattttctagatttaatggaagttttacgagaaagatttttgagcaatctaccatggatttacaaattctttcctaatcatgatatattccaggaccccatttttggaaattccgattttcaatcatacttcaatgacaaaactatacattcaaagggttcacccattttatcattcgatatactaccaggctttaataaaatctataagaataagacaaatttttactcactcttaatagaaaggccttcgcagttgacatttgcttcgagtcataatccagatacacaccccactcaaaaacaagaatctgaggggccattacaaatgagtcaacttgatactacacaattaaatgaattattgaagcaacagagtttcgaatatgtgcagttccaaacactttctaatttccaaattttattatcggtattcaataaaatttttgagaaattggagatgaaaaaatcttcaagaggctatattttacatcagcttaatttattcaaaattaccttggatgaaagaattaagaaatctaagattgacgatgccgataaatttatacgtgataatcagcccattaaaaaagaagaaaacattgtgaatgaagatgggcctaacacatcaaggcggacaaagaggccgaagcaaattagattactctcaattgcggattcctccgacgaatcctccacggaggattcaaatgtattcaaaaaggacggtgaatccatcgaagatggcgcatatggagaaaatgaagatgagaatgactctgagatgcaagagcagttaaaatctatgataaacgaacttataaactccaaaataagcacttttttacgggaccaaatggatcaatttgaattgaaaataaacgctttattagataaaattcttgaagaaaaagtcactcgtattatcgagcaaaaacttggttcacacacggggaagttttcaacgttgaagaggccacaactatacatgacggaagaacacaatgttggatttgatatggaagttcctaaaaaacttaggaccagtggtaagtacgcagagactgtgaaagataatgatgatcatcaagccatgtcaactactgcatcgccgtctcctgagcaagatcaagaagcaaagagctatactgacgaacaagaatttatgctggacaaatccatagacagcatagagggaatcattcttgaatggttcaccccaaacgctaagtacgccaaccaatgcgtgcattcaatgaacaaatcaggtaacaagtcgtggagagctaattgtgaagctttatacaaggaaagaaaatcaattgttgaattctatatttatttggtaaatcatgagagtctcgacagatacaaagcagttgatatttgcgaaaaattacgagatcagaacgaaggttcattttcgcgcttggcaaagttcctaaggaagtggaggcatgaccatcaaaattcatttgatggtctgttagtatatctatctaactgagggagcttcgaagtttaaactgtttcgtatagggataccgacatgtatgtttataatataatgatgtttactatgagaaaaaggctgccggaatatcaacggttgctgtggtgagaaaatcgggtaacacctataggggttccatcacttcagatgccttgaactttgaaatctatacgaatataggaagactgagttggtagacctggtaagatagaagaggaagaaggcttctttattaccgcaactaagaataaacttatagcttcatgcgaatctcaaaaaatagtcataagcggcaaagaacgaggctatatttcctcgttacatttattatttattcgataataccctgccgtgcggtactcgtgccttggctggatgatgacccatttgaagcaacgcttctagaaatgggggatgaaccatggagtaaggacatcctttcaagcacacctccgttacatccatctgaagttaccgaggataacaaaagcttaaaacaaaggggcaatgtaccgcaatatgtcatcgataatagccctctgctccatttatatagtgaagaaaagtactggccagctgatgttaaggattttgtaaaaagattccagttgagagaccacagtggggagaaaattatcaatgaacaccttcgtgacttaagtgacttacaagagtattattcggtagagttagagaacggaacgtggggccgagtatccagtgaaggtacatatatgacaagtttagatgattttgataagggccctgactggttgttgggtgaacaaccagaatatggtacaggtcacataaagaaagcaccagcagttctttttgtcgttgacaaaggaaatggttgggtagacgcgttctggttttatttctaccccttcaattggggtccttatattatgggctccggaccatggggaaatcatgtaggggactgggaacattctttagtacgattctataaaggagaaccacaatatctatggatgagtgcgcatgggggtggtagtgcctataagttcgaagccattgagaaaatcaaaagattgcgtcgtgttgacggtaaattgacaaacgaggttattaagaagcctttaatatttagtgcaagaggcacacatgcacattatgcatcagtcggtcaacatgcgcacgatgttccgtttttctttatgccattgagtgactttactgatagagggccattatgggatccttctttaaactattatgcctatacagtgactgtgggggaaaaaatgacaccatgcggcgctgaagaaactaaaatgggactagaatggctatcgttcaaaggcgcttggggcgataaacaattaagacctagggatcccagacaaaaatggtgcccatttcaatggaaatatattgacggaccaaaaggtccactattcaaaaatatggaaagggtttctttatgccaaagatttaaatggtggaatttttggaagggctgcccggcaagaagatatataaaaagaggggaaggtttggatgcagaaaagaatgatcttgtgggtgacaattgtggtatcttgctgtacaacataaggccaaagtggctgcgtagcatactccgttttttgacgtggaggggaagcgtatgtttcattatggactactttacagggtaatgaatatttgggcgtttttcgctattttagcatgctgtagtgtatgtactgtgcatcgtcatgtagcactatttcagccgtatttttctttttttctttcgcaccgtctgtggttgtaaagttactgacacttttttttctagaaagttccggaaaattgcgacactcggtggagctcgagagttgtatccagttttcttgttcggcgatattccgaaccaggtcgggttgggctaacagccgcccaggatggaagaattaagaatttcatagaagccttcagttcttggcgaagtaaagtggcaaaacaaatggaagatctattgcattacatatataaaagcattagaacaatcttttctcattgacaggtattctcattgctctatatatattttcttcttcttgaaagaaatatcagtattacaatcataacaacaaccaaaagaaaataactaatagaccccattacaatatagaaatgttttccatattcaattcaccatgtgtttttgaacagctgccatcttttagtcagcccctacattcgcgttattttgattgcagttctccagtgagctattatccagaatgtaaaaggaggaaagcaataaaagctaacctaagagctccaaaaaaaagcgatgcaaattgttcagaacctttgaggtatgcacttgctgaaacaccaaatggttatacattaagcttgtctaagcggattccatatgaacttttttcaaagtacgttaatgagaaattaggtgagctaaaggagaaccattacagaccaacttaccatgttgtccaagatttttttggaaaccagtattatgttgaagatgaagcggatgaagatgctctattgagatctgcattgaaagatctggattttagagccataggaaagaaaattgctaaggatcttttccaagactacgaaatagaattgaatcatagaggtgatgaattgagcatattgagtaagaaggataaaatctttaaggaattctctctagaccaagtgtttgaagatgtttttgttattggctgtggagttgaaaacatagatgatggctcgagagaaaaatatgcacttttaaagattggtttagttaagcatgaggaagaaatttccgaaggtggcatcaacgaaccaaagatgccaataattgaatccaaaatagacgagtctcacgatgatgttaacatgtctgaatctttgaaggaggaagaagcggagaaagcgaaagaaccactaaccaaagaagaccaaataaaaaaatggatagaggaagaaagattgatgcaggaggaaagcagaaaatcagaacaggaaaaagctgccaagaaagatgaagaaaggcaaaagaaagagaaggaagccagattgaaggcaaggaaagaatctttgataaataagcaaaaaaccaagaggtcccagcaaaaaaaattgcaaaattccaaatcattgcctatctctgagattgaggccagcaataaaaataataatagcaattctggttcagcagaaagtgataatgaaagtataaacagtgattctgatacgactttggatttctctgtgtctggtaatacactaaaaaaacacgcttcacccctattagaagacgttgaggatgaggaagttgacagatacaacgagtccctaagcagatctcccaagggaaactctattattgaggagatataatgggtgataatacatactccccatctttcatttttacggcattaaataactaattatatgcatcttatatactactataattcactgactttatgaaaggaatataaatcggcacggcagaaggcggatttattttgttacaatataacaaaataaaagggcaacagtaaagtagaaattattagtatccgtgattttagtacaattatttgcttcctagaaatccggttttccatgttaacatttatgctagtattttatggtggaatggcaagtgattcacaaaatacaagctactttatcgaatgattgaaattcatttctgcttgaatagaattcaactatcgtttatcgattctattttgaggattcctataccctcgaggagaacttctagtatattctatatacctaatattactactgttattaacaatggaatcccaacaattatctcaaaattcaccaatatctcaattccatctttagaaaaattaagttcaaattaacggaaacagtaatcaagtaaaagagctttttttttcttctccccttcctgccctgaagataattgagtaaatgttacgttgagaatggctttttgatatttcattagatttacttcattattcttctctattctcccctttcatcaattaattgggcgtgtggcgtagtcggtagcgcgctcccttagcatgggagaggtctccggttcgattccggactcgtccaaatttttttacttttaatgaggtatactggaatattacggctctttttttttagaaacatattcctcaaatgggtaaacggaccctggtgcaaggtgtgggtgctgagacaaatacgatctgagttgttttaaaaaggaaaacaaatgaatgcgtgcccaaagcggaaaattggtcaacatcgatgcgtaattagtaggcccaggtgagcctgtgccgaacatgtatctctgcgcagattactatatattcccgagcataacagcatatagttttctttcacataggccttcctccaactgccatcactgtacatagacgtttcggcactgtatattcttgtccctttttttttgcctactacattgctgcattcaaacgatatcgctctgcgaaccgtttaaaactgaccaaaatagggagacctaccttctaaggagaaaaaattcgcattgctaaaaaaaagctaaaagagaaagagaagaagaatattaaaccagtatattctactacaactatcgatttactccgactacaaagtgcctcttcgtattttcagtcgctcgaaaaaacaacccatattccatttgattctacgcagctggtagaaacttttacaggtttgataaaattattacaatcgttagcggttacgcaaggaataggaaataaagaaacggtaaataataagaaaaacacagcagatctaagcctattgcacacagtatattataaccattactagctagtgttacataaacaatagcagaatatgtctgtgcgaaacctcaccaataatcgtcattccaacagcgaaaatagtgtttccggaagcgaaaactccttttattcctcgaatgagcaatcaagacaaagctcatcattagaacctgcagatggtcagaacgttagggtgagcggtaatcctttccttggaagtgaagaatttgacgaagattataattcacccagtggagacgatgagcggcgtggggcaaatgaatattccagttcttcatccataaattataataacgatcctaacagcgatacttctcttctggctaatgaaaagaactcacccgagagaaatggtcaaagaatgtcagactataagggctattatgctaagactaacctaacttctgctaataacttaaacaatcataataacaataattataagaacattataagcagtagtaacgataatagttttgcatcacatttacagccgccggacagaaacttaccgtctcatccttcttcaaataatatgagtagcttttctaacaacagcttaattaagtctccaccaccttttgacagatatccgctagtaggaacgaggcatatttcagcggctcaatctcagtcgcagaaccttataaatgaaaagaaaagagcgaatatgactggctcatcttcttctgctcacgactcttcattatcatccaccaacttatacatgggcgaacaggatttttcgccctttggcggttatccagcttccttctttccgttaacgttggacgaaaaggaagacgatgactacattcataatccaaatgtcgaggaagaagcaaagttagatagaaggaggttcgttgacgacttcaaacacatggatagaagatctttcttggggcttctgggtattctatttttatttatggctggtatatttattttcattgtattacctgcaattacattttccggggtagtttatcatcatgaacatgttcatgcggcaaattcagcaggatcgtcgtcttctaatactacatccaagtcattgactgaatatcaatatcctcaacttgcggctataaggacaactttagttgatccagacacacctgacagtgcgaagacaagagtagcgaaagatggatctaaatggcagctggtgttttccgatgaatttaatgctgaaggtaggaccttttacgatggcgatgaccagttttggacagctcctgacatccactacgacgctacgaaagatcttgaatggtactcaccagatgccgttacaactacaaatggtaccttgacgttgagaatggatgcattcagaaaccatgacctttattacagatctggtatggtacagagctggaacaaactctgctttacagaaggtgcgttagaagtttccgcgaacctccctaattatggtcgagttacaggattatggcctggtatgtggaccatggggaacttgggcagaccaggttatttggcgagtactcaaggtgtttggccttattcatatgaagcatgtgacgctggtataacaccaaaccaaagttccccagatggtatttcttacttgccgggacaaaagttgagtgtttgtacttgtgataatgaggatcatccaaatcagggagttggaagaggcgcaccggaaatagatattttagaaggtgaagctgatacaattttgggtgttggtgttgcgtcacaatctctacaaattgctccatttgatatatggtacatgcccgattatgacttcatcgaagtttataatttcaccacaacaactatgaatacttacgctggtgggccttttcaacaagctgtctcagcaatatccactttaaatgtaacatggtatgaatttggggaggaagcaggttattttcaaaagtatgccattgaatatctcaatgatgacgacaacggatatattcgttggtttgtgggagagaaccctactttcacactatatgctacttctttacatcctagtggtaatattgactggaggagaataagtaaggagccaatgtcagcgattttaaacttaggtatttccaacaactgggcctatatcgactggcaatatatatttttcccggtgacaatgtcaatagattacgtccgattataccagccgaagggttctacgtccattacttgtgatcctgaggactacccgacatatgattatatccaaagccatctaaatgcatattataacgccaatttaactgattgggaacaggctggatatactttcccaaaaaatattctaacaggaggttgtagtagttcaaaattctcattatcctgaggttgatttttttttttcaactggttaaaacctactatctaagtgcgctttaattctaaggaggcaaaatagtctgcggtcacagtcgttgaaagttctagatttgggtacggaagcagccatgtaaatggtcttcctttgtaataatatcatcactggagtttttaaattagagtacggattcaagttagcgaaaaatttctgttggtatctgatagcaatttgtcgacaaggtggagagtttttgaagtttttttttgtaacagttatgttacactatttaccagagaaacaccaagacaggagccctcagaagctttcgtgttgtcagaacataaatatcttctatatgttttaatcttttatattaatcaatattttatgttaaatcatattattattcgttaatggttaacttgcgctatttcaaaattggaaggatagtgtggttacaagcggtgtttttgatgtatgtttactgctaagagtataccgtcctgtttacttttttaccttttgttccgttattgatttttcgcagcaaggttgaagcttcaaatttgaaaatgaaattaagacgtagagatgaaaaacagcgatgaaattactttttatagcttctttcccatctgactccgttttataaacaggggttctttaagggcttacaaataaatataaacactaacacatatatattattcgacctacagtttttgcgaccaatgaagtttacctattttgagttagtgcttacgtagtttgcttaaggtcaaggtggtattaagcttgcgctttctctaaataatatcatatggtacagacagggataagtacttcataataaaccaattgctagtccagtatttttggtaccctcttactgccgcgaaattcaacaactttttaactcgtgaaagaggttaatattattattcattttgctagaaatactactaaacaccccattaggaagctggtaaattatgaaatcagcaaaataagatccaaccggaacgaatttattagaagctcaaacacaagggttgatagtgtgataaaggaaaggggtgacaacgtgtagagggtaaaacttattgattcctttttgtggattcctataccctacaagaacactgttggatatagacattatatgcaatattaattatgcgactgataggcttcgtaattcctgcttgagtaaagacaagaattttcatttctcattaactgtttttatttataacctaggaaaaaaaggagctgaaaatttgttggaataaaaatccactatcttatatcaactagtattcctaatgtcagtatattgtcatataaggcgttagatggtgacataaggtatgaaaagttgccatcgaagttagaggaagctgaaatgcaagcattgatgtaataggatcaatgaatattaacatataaaacgatgataataatatttatagaattgtgtagaattacagattcccttttatggattcctaaatccttgaggagaacttctagtatatctacatacctaatattatagccttaatcacaatggaatcccaacaattacatcagaacccacactctcttcaattattatgtagaaatttcgattctattttgaggattcctataccctcgagtagaaattctagtatatcctacatacctaacattattgctttatcaataatggaatcccaacaattattgttacaggctacgatattgcgtatagaaaaaatgttgaaagttcttctgcaagatacaggaatccaaagggaatcaatatatctacctaatagtattattatttcttttccattttatatgtttcactatcctactatttcatcgatcctcttatttaagcttttattaaacctaatgactgttctataacttttatgtcctctttttacatcataaatgataattaatatactagtgacatgaatactaatcgatggatggtagtttgttcttattctatcagggaaatgcatcagataatggataaaatggaaagaatggaaaggaattgtaacatgcctatatatggaaaacgagcttttagagctttcaagttaaccccgggcggttagtgtagtggttatcatcccacccttccaaggtggggacacgggttcgattctcgtaccgctcaagattacttttttaattttcatactttttctcctaatatcttgcaaatcatgactgaattgacattaactgatgcaaatgggtgggaaaaatgcttatcaaccccctaaaaagtcaacttcttcgttagtgattgctatatgtggcgtcaagaattacaagaagctggcgagctttccaagccccttcaggattaaccgttttttaccctttttttacaaatttacggcggggaataattctgatactttctctttatgagcattcctcaacagggatcggcactcaattgctttagtgaatagtttttttttacgccaagaacatttaccaccccattttcctgtagacgtccaaaacgatactctactttaagccctttttctgaagttttcataaaatgtccgatctcctaacgtcatttttaaaatcaaatggtcttttaataattatgcacgttaaaaaacatacataattgatagtaaagaatctggtattctatcagttaccaagttcaatcgtaaatttttttacgagcactaatagaaatggatcatgaaattgattttttgattttcaatttatgaactacccagatatataaatattggaataaattgtgtattaagtagtcgggaaatatcttttatgttctctttcttatcatctagaaataataaatcacaaccaaaaaaatcaactaactatcaaaatgtctgctacctctactgctacttccacaagtgcctctcaattgcacttaaactctactccagttactcactgcttatctgacatcgttaagaaagaagattggtctgactttaaatttgctcccatccgcgaatccactgtctctcgtgctatgacttctcgttatttcaaggatcttgacaagtttgccgtttctgacgtgattattgtcggtgcgggctcttcaggtttatccgccgcttacgtcatcgccaagaacagaccagacttgaaggtttgtattatcgaaagttcagttgcaccaggtggtggtagttggttgggtggtcaattatttagtgccatggttatgagaaaaccagctcatttgttcttacaagagttggaaatcccttacgaagacgaaggtgactatgttgtcgttaagcatgccgctttgttcatctctactgtcctttcaaaggtcttgcaattaccaaatgttaaactgttcaatgctacctgtgttgaagatttggttaccagaccacctaccgaaaagggcgaagtcaccgttgctggtgttgtcaccaactggacgttagttacccaagctcacggtactcaatgttgcatggaccctaacgtaattgaattggcaggttacaaaaatgacggaactcgtgacttgagtcaaaagcatggtgtcattttatccactaccggtcatgatggtccatttggtgctttctgcgccaagagaatcgtcgacattgatcaaaaccaaaaattgggcggtatgaagggtctggacatgaaccatgccgaacacgatgtcgttattcactctggtgcatacgccggtgttgacaacatgtactttgctggtatggaagttgctgaactggatggattaaaccgtatgggtccaacttttggagctatggctttgagtggtgttcatgctgctgagcaaattttgaaacactttgctgcttaggcttttaatgaggtatgcttttaaagatttatatattttttatacacgctatatacacaattttcgctgatgattttgttttattattgatttttaaattaaccgtagaaaatactaagtggaaagatccgatagtgatgagataagacttttagttatctctgtaatggtgagttttcgcacatcttgcaatattaaaaatataaatcaattcttcaaatgtcacttcatggtcgggtaaccaaatatgatcttaaaaaaaattaagaaaaaaaaaaattgaaaattttgagctaagctcatctcatctcatcggctgtaatcagtaacacatcatttattacatcagttacaggtatcaacatatatcttcaaaaaggggacattatggttttgaaatctacttccgcaaatgatgtttcagtatatcaggtttctggtacaaacgtttcaagatcacttccagactggattgcgaaaaagcgcaaaaggcaattaaagaatgatttagaatatcaaaatagagtagaactgattcaagattttgaatttagcgaagcctccaataagattaaagtgagtagagatgggcaatattgcatggctaccggtacatacaaacctcagatccatgtctacgattttgctaatttgtcactgaagttcgatagacacacagatgctgaaaacgtggatttcactattctctctgacgattggactaaaagtgtacatttacaaaatgatagaagtattcaattccaaaacaaaggtggtctacattacaccacaagaattcctaaatttgggagaagtttagtttacaataaggtaaactgtgatttatatgttggtgcgagcggtaatgagttatacaggttgaacttggaaaaggggagatttttaaacccattcaagttggatactgaaggcgtgaaccatgtttctatcaatgaagtaaatgggttgttagcggcaggcacggaaacaaatgtagtggaattctgggatccaaggtcgcgttcccgtgtttcaaagctatatttagagaacaatattgacaacagaccattccaagtcaccacaaccagtttccgtaatgacgggttaacttttgcatgtggtacgtcgaacggttattcatacatttatgacttgcgtacttctgaaccttccattattaaagaccaaggttatgggtttgacattaagaaaattatttggttggataacgtcggcacggaaaataaaattgttacatgtgacaagagaattgcaaaaatatgggatagactagatggtaaggcatacgcttctatggagcctagtgttgatattaacgacattgagcatgtaccaggtacaggtatgtttttcaccgctaacgaaagtattcccatgcatacatattatattccaagtttaggaccatctccacgctggtgctcattcttggattctatcacagaagaattagaagaaaaaccaagtgacactgtttactctaactacaggttcattactagagacgacgttaaaaaattgaatttaacgcacttggtgggatccagagtattaagagcatacatgcatggtttctttattaacactgaactttacgataaggtttcattaattgctaatccagatgcctacaaagatgaaagagaaagagaaattagacgtagaattgagaaagaaagagaatccagaatcagaagttcaggggctgttcaaaaacctaaaattaaagtcaataaaacattggttgataaactatctcaaaaacgtggtgataaagttgcaggaaaggttcttacggatgaccgtttcaaagaaatgtttgaggatgaagaatttcaagtcgatgaagatgactatgatttcaaacaattgaatccagtaaaatccatcaaagaaaccgaagaaggtgctgctaaacgtattagggcgctaactgctgccgaagagtccgacgaagaaagaattgcaatgaaggatggcagaggtcactatgactacgaggatgaagagtctgatgaagaagaatctgatgatgaaacgaaccaaaagtcaaataaggaagaattaagtgaaaaagatttgagaaagatggaaaagcaaaaggcactaattgaacgcagaaagaaggaaaaggagcaaagcgaacgttttatgaacgaaatgaaagccggcacttccacgagtacgcaaagagacgaaagtgctcacgttacatttggcgaacaagtaggcgaattgcttgaggtggaaaatggaaagaaatcaaatgaatccattttacgtcgtaaccaacgcggtgaagcagaacttacttttattcctcaaagaaaaagcaaaaaagacggaaattataaatccaggcgtcatgataattcatcggatgaagaaggtattgacgaaaatggtaataagaaggacaatggtaggtcgaagcccagattcgaaaatagaagaagagctagcaaaaatgcgttccgtggtatgtagttatattagaaattgatattttaattatcctttcaccttaaactaaaaatattatatgtatgaagacgaagacagcaaaaagtatgcgtgatacagtttacattatagaattctttccccaaatattgagggttttgttttttttttttaatgcagatgtacgtacatattttctttatcaaaaggatgtgtagagaactatgtatatatgtatatgtgtaggttttttttttttaggatgactagaaaaggaaatcgaaaaagaaaaaataagcatgaatcatgagtaggttaaaggcaagtcgaagaagatacgaagcaagtgaagccgtttaactggaggatagtctaaaccataggttgtagttattctcaatgatctgatctgagatcaaatgatcatcaattagatcgtttgatcgtggcaagttgttttcgtaacccaaatgtgcctttgaatgcaattggtaactagaatcgagtctaagagagtcggctaagttcaaataatgttcattttcatcatattcgtcaacacgagaaggattagactcctgcttaggattgactataccatcctgaggtagcagcaatggtgaaattaataaggactctagcttctccaactcgtcaaaggggatagttgaagatgtcggagatgaagatagtgaggtagtcggctcgaagaggtttgatgcagttaaatttttagaatatgaaagcggtggagtgagattatgcgaatgagaagtttttgattttttatgcaagtgggataataatttctcattaagagggttcgaatccttcagcttacaatcttcggagcaatataacttatttgattgtaaactgctcttggtttcattgtccctttggatcttcctggtattaatgttcgttttctgtggagatgttggaatgagacgatcacaaacagtgcagtaatcgttgaatgcggtgctcattatatgattgatatgcaaatcggtaaagaatacctgaaaggagtggagggataagaataaagtaattattctcgagctttttttataaggaaaaaaaggagaatcggtagcggagtattgtttctctattctttctttgcttactctgttttataattctcacaagtgttcaatttttaacttcttgggacaacactatagttctaagttctttagacagttcaaagacagtttactcaatggcgatggcctgtgtcaatgattatattgtatatatatatgtgtccaagtatggatgtgaatgtatctaaattttccgaaatgcaagaaataaaattctcacaattggggtgttgaaacggaaaagatcggtattcctttaaatataagaatcaccacgtttcaggtctccaagttctagctaaagatcgtacaaacaagtgccaatttgggaaaaaagggcggcctaattgtgaaaaaaaaagatgcccaactgaaagaagggcaatgagcaatagggaatgtaaacgaatgcaataagaaagcacacgttaaattacactcagggaggaaccccataataaaaaagtaagaaaattgaatgatctgaacccggtgcgcaaaagcgatgagatggggcgatgaatgacggtaataaacacggtagcaaatacacccgagtcgtgtgccctacattaagaaaaaaagagatgaaaacttctcctctattccgcggtaacctatggtcacggccagattttttccaagtatttttagctcaaaagctgaaccgctttagctggccgactaagcgaatcttctggaacatatgtgaaaggcgcactaggattttcgttgagggatgagcttcccgttgagaattaatgcgacttcaggcggcacaatacgatctgttgttgccgtttgagtgtcgtttggcacgtggaggtccctcctcagtgctcattgggtggctcggccggggtacagctagcaggattaacgatccctcttagaaggatcgcgagcaatagcactagcaaccgggcttatgtaaaatgagtacggtagaagcttctatgacctgttcacgtggccaaatgttctgttactagtacgtaaacaacgtggttacgtagaaaaaagaaaagaaatgtaaactctatatacatgctaagcctacgctaatattctttcacattaggccatcaaaccatttctggcctttggttcttggtttgcgctttgtaatgtcgagcgctgtgccctcattcttgatgaaatcgctagggttgttccctttgtatcttattttggcaccagaggccatcgtttggaatacctttttctgcttcttcatcaagtcgatgccaaacctctgcagaagcttgacgaaggatggcgttagcactgccgtcaggggtactctaacgatgatcaaactcttgtgtatgccatacgcaattagcaattcggccaacaacgtgctgtccttcatctcttgccatctctcattgaaagttttcctcgatgcgtcctccaccttgtcagcattctctgcttgcactgcttcgcgatgagcctgtttccttctaacatcttgaatgactttgctttcgtcaggctcacccatcccaatcaattgcttacctctgttcagatagatcttaatcttctcttcacctagtgagtggactcccagaaaacataatggcaaatcaacacaagttaagaggatatatacgatcagtgcagaataaccatacttagccattaatcctttaataccgtgtggctcatttttcttcccattgttacttttgcttttattttcatcaaactgactacttttttcctctgtactgtaaaattttctgtcttgtgctgagtgcacacttatcccaggtcgtaggagaaggcattttaccatactcctacaaggggcactaaagtccctgcgcagtgtatgggatacggttttctgtatgggtaaagttacaaatccccatcgaagaaatatcctcttgaaaactggtgaagcactaatcctgggtaccatcatcaccccaactctagaccaaaaaagaaaatttcaaaaaagaaagggaagatctaatctccttgcagcgatctaagaggaatttatgctactttttaactttggttttcccttgttcttaaagatgtgatatcatgtaaatgtcaagcccataggcttcgtgaaaatccacttgaagccgggtaacgatcatgaacaataacaactgctcatcccaaagatacctttatgacgttttcaacgtaacgcagatttctattgtatcacggtcttttatatattatattatttgatacttaacacaaaaataagtacggatcacgtttttatttttttatttcatttttcttgtaatgatatattattaataaaaaactaacaaaagttaattatcttaacgggaagtggcggcaaccttttggaaagcacccttagcttgttgcttggaaaccttggaaccttggacaccagcggacttagccttttcagcctttctagcagccttttcagctctcttcttttccttgttggctttcaatttttcttctctgttagcttttctaacttctggcttcaaagatcttctttccttgatcaagtccaaagaagcaccagtgattggtctttgcgccttaacggtctttctagatctcttcttagcaacttcttcggtgatacccttcttgtgatgctttctgaacaagacggtccaagcgattcttcttgggttctttctttgtttgaacaaagaagcagatttggagttttggaatctgaaaattttggagtcaccacggacaaataaagtacctctacctgggtagatcttagcgccggaaaaggaatcaacttcaaccttcattgttcttctaaattaaaaagctgtgaaaaaccacaaggtgaaatacactcatggtttatatacaaattgatgttagtacacaattttggttcaaagagttttaaatgggagaaaatttatcaagccgacaacgagaacagtatttcatcacgacaagcatatccaacagatcccgatgtatatttgccaatgatgttccgtacgtctttcgacggtcctgatttattcgcatgtacttttctgggaagatgttcaacgttgattaatataacgcctttatcgtgggcctcttattaacctcagcattgttcaaatggtcgcttctttctcaattcctacactgcgaagctcctcgttgtcctcaatattctctcatttcctaatgggcacgcgacatacgtttcaattcaaattgttgctcgcctcttttgttgaccacccaaaaatttaaacgcctataatttagttaatcaatataggttacctgtaaatattggtaatatcaactcccactactactgtttctggctagatgtcaactgcgcaagagcaatcaggccaaacgggaactcccgtcaacccatggctggagttccctcaacgggaacctctacattctcctacagaggcgcaggctcacggtaaggaacccccggtagtgttgcgcgctcaacgacgcgaaagccttaattgccgcagtacagagtataaagtttttaaaaattgaaaattagtgattgggtttagagtatgcacggatgttgtaaggaatattgtttggcaaagtttcacataacgagatatatgctattttcaaacaaataatcctgccaacactagcgataataggagttgtggaaagcttggacaatgtacattttacacacacatatacatacgcacaaacggatgtacgtacaaatatttcattaacataatatcttatccagcacaccaggcatattaggccaccaaattacgtatggctgtatttcggtttggcattataattttgaaaattatctcgcattatgtgtgacttcgccgaatattcacaagcagatcaaatgctggctttttttagacatatcaacccctaaatgggtttagcggataacaaatatatatcaatagtaatataaggtatattcaatagagaagctttgacatcataaaagctcccatttaacaaaaaattatctccacattgtgataccatttagagtggcactcatcgctatctttatcgtaatgtacaagttggacaataacgacattgacgatgaaacgaataactctgtttcactgacgagccttttagaatttctcgacccgatcgcttcaaaagtagtttcaaaatactaccatggttctcatctttcgaaagcagaacagaaattgcgaaattttgagggttttagaagacgtaaaccccatcatgaacatgatagtcatcatccacatcacctgaatagaagtcgctctttcttgcaattagaggacttcaaagtaagagcgttacaaagaattaggaatctggataaacccttggattccatttttttcaaaaacagctcaaggttggagaaagcattttaccctttcacactgtttaatatatttttcatcggatttttgatgggcaggtttccagaatggtttcatgtttactataccatcctgttcttcgttctgatgcccatacgtttttacacatactataaaaccaaaaaccactactttctggctgatttttgttactttgtgaacatgctatgcctattgtttatttggattttcccatattcatacagccttttccagtcatgttttgcattcactttcggaacgttatgctttgccgttattacttggagaaattccttggtaatacattctatagataagactacttcatgcttcattcacataatacctccctgtgtcatgtacgtcatctatcatggattaccactcgaatacaaaatcgaaaggtttccgggagcaattattcaaagtgaattggacatcaaaaaaaatattctttggacatccctttattatttggtttggcaatcattataccattacttcatcacgttgaaaaagtctagcaagatcaagtcaggggaaagaatgacaagttttgaatatttaaccacacaccaatttaaaaacttttgggcagttaaattaaggtcaccttggccgatgataatttacacactttctcaatatttctatcaactattcactatgctattgtgtggcatatggattcgttacaaattagctgcggccctatttttaactatagtatttctatgggcgtctcataatggggctacctactatatcgaccactacgggaagaatttcgaaaaagaagttgatagattacgtcttgaagttgagaatttacaacaaaagttacagcctgattctgatgcagtcatatctgatgcctccgtgaatgataaggattacttgaatgtcaaccgtgacgaagattttgacgactcttcaagtgtatcctcaaagagtgattaagatagttcacttcatttatctgttaactttgagagcttttatttacaggcgctttactatatatatatatgtgcatgcatggacgcgtatatgtcgtttcttgatatataatcacttttagtctaatgactacatgttaagttcttgttcctcccacttcagggcctttgcgtgtgactttttgtttactacatccagtaagatttcaacgctatttctatcctcgatttcttctaatgctttatgcaaattcctaaccatggaataagtccaattgaagcgattttttgaagacaatatgatagctattgcgtccgaatactttccttgctttgtgaagaattcaaccattagatgggcaaatttctgatcctttgctattcttattctttggtccattttcagaaacggtacagtcgtcctaaatttacccctatcattccatactttctttgctaagtcctcattttgaaattctatagcggctttcatcaccagctcatataacgtggtgtccatcatgattttgtgcctcaaacatgtaatataccatatatcatgcattattaagttgaggtcttccgtggtctcaggtttggatactgagatggcttcagttgatattgaattttggtcacgcgtatgggacgaaggaatattacggtatccttcatacaaacgctttatgacagcttcaaattcgtgttgttggaaagtgaagaacgtcaaccttcgcaagaattccttctgttgttttaagttaatgggaattgacaaatatgtgtgtagtgaaattttattgaagacgttcacattaatactttctctttgcattttcgtcacttcgtacataactttaaacttaaactcgttgaaatcctctgcttcttgcgcaaacgaatcaagtaattgcctatattttttgatatcctccaacgccgcttcatttgaagatgtcaatgtattgcgcgttcctccattttccatattgaaactccagattgcgttagattccgccaatacttgtgcctccgaatttaggtcactaattggaagaaatggtaatttaaatttgaccaatttgtctgtatcatctaacctcatggaggaatcaaattcgcgaagaaattttcttctcaattcaatgcctttttcataaccggataagactggcaaatttctgggatcaaatcttgcataagcaagcatcaaataattcagcatttctggcattaaagttgacttccaaattgtatcttgatctacgagaatgtttcctttccaatttgcgcacaaagttttgtactttttcgcgatgaacaagtaatatagagctctacttaattcaatatcaccatcaaacgcggctaatgccatcatagccaaaaataaatttaagtcatcttttttatgtctgtaaagattcttgtcctccaactcatgaaggtatttccatcccagtaatcttagagagtctgatttaccctcactgacaacggcattactgctcgaagaagccaacactcttgccatcattatgtaagtgtttgttgtaggctttatattgtggtcttgaatttcttgaaataaatccaaagccttaggaaaattccgttccttctcgcatattcgcagcattgtgttatatgtgcagatatcagggaaatgctttgtagataaaaatttcatggtgtcaaaagtattccaggcttgcttagtcatttccttcctagagtagaattgtattacagtagttaggttttgcttattaggagttatgccataatcatctctgaattttgtaataaaataatccatgtcgtgaaagcttgaacacttggtcgagtattttaaacaattattaagtattgcttgcgtcatctttggtactttggaagggaatccttcttttttgttaattctttcttcagttatttttaatgccttatcatacctctctaacaactctttcattttgaggataactttatcgttagtaccatcctgattaaaattagttggttttaaatttcctaagttgttaaagatacattcgtacatgtgggtattaaattttacaacatctccattgatttgttctaatagcatttcatccaagtgtagtatactatgaaatggcaaatatttgactgtaccatttaaccaaacagaaaattctctggaatcaatatccatgaaccgtttctcactgacataaagcctatctatgacaggtgcccaattactgtgtgatctatcaaaaaggttttttgcaagtatgtcgtcgtctgctactctttctcttataacttttggtacgaggtgatccattttttctaaaaacgaagaatgaatcaaatctgatagatttttggatttttcttcattaggaacagatgatgttttggtgacattaacattccttgagtcttctgagattggtgcgatactattgctttggtggccatctgaattcaccgatttagtgttgtgaatgcgttcttttaaagtattagaaaattctcgtaattgtgctaatttgaactcaacgtcttcaggtgttattattttatttttacttaaactccccatcatattcttttcatcttcagtttgtagggtatacttgaaacgcttatttattagtcgttttgaaaatagaaaggaaagttgaaatgggaaacacagcacattattcttggggccacatctggccatgtacatgtttatatttatctatctgttaggacttgtgaaacaatgctattttcctgtgcactatggactatggctttgcttttacattttatgcctccaatttttcacaatcctgtccgacgctcagatattggtgtggaagtagagctaactctctatctcagaaaaaaggttagagcaaggcagatcttttgcaataagaatcagttaccatcgatcgatttgaattcatattactagtactttgcaatacactgtgtaagaagatgtcataaagattgagaaacggtcatcaaacttaatgtaagcagagacacgaggattgatgatgaagtaagataatgtgcgacaaggaagaaaaaataatagcattatgtagagatatcgattcccttttgtgggcgctatgttctggaggagagtttctagtatattccttatccataatgttatatgtgatctttatcaacagtggaatcccaacaataatgcaattattcacccatttttcacaagcaagcaagcattatgagagaagaacgaatgtacagtcatttagatgataagattggaagtaggtcatgatagtcaggattatgtaaagacacttggtgtaaccctgtatcggctgatttataatatcgagaaagataatataagaagcgcctgagagtcagtggatcgattatcgaaaatagaatagagacgttcacggagacccactgaatgtttcgtattaaaggagggatgactactaaaccattttcaccgctactggtggccattttgtattcttccatttacaagaattgctcccgacttttgttccatcagtggacgatagaccattgtcaaacacagtaattctattttattcttgagatgagatgccgcaatatgacctgatatgaatcaccctaaatgtccgatctaaacaaataaaaggcgtgcgaaacagcctcacgacgagatatgaagtcgaaaacatcggcctaatttctgtgctttttagaagactactcagattttcaatatcaatacagtgagttagatctcaggttgagaagaaacactttgattttactagataggaaagaaaaatggactaattaatcaatcattttgtcatcgttgaaacttgataacgcacgctaaacgataacgactatgttggagggaaaacattaacgattactcttttaagtaattgcgaagtatatctgagactaaagaccctctgaattaattatatcaatcaacataaactataagaaactacagtgtgagctttagttacgagagtgtggatctgttcatttaatattttttatacgtaacgcagcatctaccgtaaaatcccatagattgcgggcacatggcgcagttggtagcgcgcttcccttgcaaggaagaggtcatcggttcgattccggttgcgtccatatttttaacatttcattttttttgggtttaaatttattttcaaacattattaattgatttctttaaaaacttatacaacgtatgctaatactttaaactaaaccttttagaactataataaaactatttcaagtaaagtctttttatctgatatcttgattcatttataataaaattaagtgactatagaatagtgcaagtggaagcgtttttcttctttttcttttgttgtgaagtagcgctaattcctgtcctgttgctagaaccagatttcggaacggcatgtgacggtttgtgcttttcattaaccggagtagattgtttaactttagcttgtccttgtgaagatttgttatataaaccttttgatgattgcttattgtttgattgtttcgtatcctgtttcgcagaactagggagcctggttgatggagactcgattttgctaaattgttgactttgatttcttgcgtctttaactgcaacactttccatttcattccgaatgatttgcctaactaaatcaacgaacacttcatccacattgctcctcaacaaagcgcttgtttcataaaagggaactctaccccatttactgcttacctctataccttcttccacacttattaccctttcattgattagatcagccttgttacctattagaaccattggaacgcgatcggaatctttgatcctaaggacctgttctcttagctccattaattcttccaaagattgccgatctgttactgaatataccaacaggaaccccattcctgactttatgtataattctctcattgcagtaaattgtgctatacccgctgtatctaaaatttccaggtcgaataccttgttatcgatctcgatggttttcctgtaagaatcttcgatcgttggatcatacgtatccaaataaactccctgtacaaactgcacggttaagcaggatttaccgacaccaccagcacccaatactactaatttatagtctctcattagtcctaatgtttcctagccaaatatttctaagcgatgatagaagccaaaatattagaacgttgtatgtaaatgttctatatcgttactaaataatagtattattgttcagtggagaggatgaaatttcaaaaacttcttggcgtagttaagaacgaacgcaatggttctttttttcgagatcgagctctactttacttttttctttttctgtccttctctcttttctttttaacctttttcgacgatatttcgcgtttgagaatgtcgaggatgaatgcgctttgacgcgaattagttgtgaggctgacgttgtgataaaaaggcgatgattcttgggaatatacagtctgtttccacttgctagataaaatgtatgatattccaaaaatgcctttctctattgaactgtatgactgagatacgcctgcttttaccttgtatattatgagtactattcgccttttcccataaagttgtttttttctggggtttatgtgtatcgtaaatggtacaaaataataaaattcttatcttgaaaatactgtttaatacttttcatcattactaaataggttacgaaaagaggtctttgagaaatgggaaaggcctgtttgaataaagaagtcggcacttacgaatgtgagggggaaagagatacctactcattttttacctctctctcagatatacaggattcaagtagtaacgaggaacaatgcggtgtaggaagtatattgagtgaagatagtttcacgtttgaagggtccaacgtgagcatacggttattttccttggacttaaatgccttgaatgaaaatgagaatggatccaagaatcctgtgaaatttaccattccgccaaaaatagaacaaagaaaggaagcaagacaaagagagaaacgtttaaggagggtggcagtactacctgagaattcgagaaactaccttgttgaatcaagtatggattcaagtagggaatacagtcaaccattttttgactggaggcatgaaatggtagaacatggagaggagagtgtaaaaccgtgtggttgtcataaatcgagaaaagcaaaatgcttcaaagaactggagatggagaatatagaaaagggcgatataaagaagagtctcttttacagagacataattgaatggtgcagagactatgaagtcaataaaactagggaagtctgtgttccgtctatacacgagttttacctacatggaaatggaagtgacaacctcttttgaagtatagccatgcatataaatatatgtgtgtgtaagaaaatattagaagttttcataatctagaaatgtcaggctttgggcctaatggcactataccaaactgattgatcttgttcctacttacttccatcctgatgtaaaagagcttaatatgattaaaatctgtagtaaatctaaactctgcgtaattccagtatagattaatcaaccacaaatgaaggtacgggaaaccatcccttatagttttcaaattgcatttgaagtgctgcacgtacacgacgtcaaatctaattattgatggatacaatctgatatccgcttcagttaacctctgtcctaaaacaaaatatttagccaagattttctgtttgttaccactgaattgctcctctaagcgcttataattttcttttagtacacattccatcttctgcaagttttcaaacagtgtttttacttcagtttcgtaaatctttccgttttctgctaatccgactttatagacaccaagattaatcttcggatgaacccatttgatgttcttatcaatctcgtctattaaatcatgcggaactagatcaatcacgttcgtttcttcgctttggataaattcatcaaacacgccactgttcaaaattcttatgatatcgccactctcattgttaacaattttccttgttttagaatcccacagaacaggcacagtgaactttgtaccggggtacttaggatcatttaagtagtacaactcgcttaaccttgatatattttccaccgggtcgaaagcgccatccacgaacaaccttgcagagtcattgttcacatcacctaactcctcagattcgtctaatttagctgaagcaatgccaccagtggcagtaaagaatctctctttatatttttccggccggtgtggagcaggtaagaaacgggcacccttggagtctaattgccagtgagataacacaagccctagaacaggttctaatttcttcaaagacctggcaagaatggctctatgagtgaatggacacccaagggccccgtaaatataataccttcctttttctggtttaaaaacagaatgtgtcttagaaattgttcccttgtaagatactgacatggcttactgtttatgattatttttacgagtattttcctctataagtggccatctctccaattggcaaagtcaagacttttgttatgtcaatatgtgctaccaaaaatcaagggtattttcccaccagagcttatcaatggcaactgtgagatatgaacagcagttagtaagggtgtgttctcatccgaccctctgattcatttggtggccattacattttccctcaatgacacattcccctatttcataactgattaaaatggtaatggcacgtgatagtagtggctcacaaaacaaaattttctttctcagcgctgacaaagcttcatttgcattctaaccttatcacaacaacttcaacttcacccaagtaaggataatcagctctgtcgtgactgataaatgctatatccggcatatgcagtccacacggcattaccgtttcactaatttattgccatcttcctccacagttttgcaccgaaaggaaaaaaagaaaccaacaccgaaaatttttttctcctaaaggttaaagtaaacgcaaggcacttcaccaggcttgtatatataaatgtcgtgatgcttctatgccaaagtaaaaggcaacacttgaagatttcgttgtaggccacttgctcaaaggacatctagataaatacgacgtaagaataaaaatgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgacccattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctgccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataaataagaacccacgcttcaaataaaagcaaacatagaagcaaaatccgtcattcctttcctattcaattgcaccgttctctttatataactacttaattaaatagcgcctatacgaagcagcattgttctattatttttacaaattccttatcatgcatgcatcacatcagtgtttgaatctgttaacttttcactttattgctcttacccgactctgaagaaaaacaaaaaaacagcgacatgttggaaaggtcgggcagtaaagcagaatttcagaaatactagtacgattgtttgaggtcttgcgaaaccgtgcattcataatagcacctttttcagtcgctcatccggtcgtcctatctgtaaacgtcactgtcaaacacgttgcattgattagattttattattttatatataggtatatttagaaaactcacaactggagaagacgaagaacgaagaacgaaggaaaaaaattgatgacagatcccagaagaagaacaggccgtcatttcttgacaccggagaatttatcctctacattacaaatcacaaacttacctccagaatggaaccaagatataattacttcggtcgtggccggttctggtccagttatagatataaaagctaagaatgacccgagaactggtaaactaaccggtgtactgttcgattatttgactagtaaagattgtaaacgcgcttgggaaattttaaatagaattgaaaactttcccgtaaagatagagcaaataatcccaccaaattataaggaccatcttagagaaacagcaaataaaaattctcaaaagcaggtattacaacttaatagagattcgtaccccttcgaggcgggtttggagctacctttcgaaatggtgacagaagtccccattcctaggcgaccaccgccaccacaggctgcaaataacacaaactctgtatcaaataacacaaacattcaattccccgacatactaagtaaagcatctaaacacttgccaagtttccaagatggctcgattattgcaccagacaaaatttcacaaaatttaagtaaaattccgccgttgcaacttattgaaattatatcaaatttgaaaatattatcaaaccaagaaaacatccaaaaatcgcaattagaatctttcttagatactaacagtgatatcacaatatcagtgacccaagccctactagaaatgggatttatagactacagcgtggtgactaaagtgttgaaatcccaagttggcgaggccccatctttgctttcgagtaataacacaagtaattcgaacacccccgtaagcgtaattagaaataacactccgttgcatgtaccttctaatgaagtcagcaacaatcctaacaatatgccactgaacgtagctatgccaatgcctatgtcgacaccaccatttatccctttacctctgcaacaacaaccgttcggttttgcgccaccgggccctttcatgcctccagctcaaggcccctccatgggacagcctgtgttggcaaatcaactcggccaggtccagcaacaaaatataagttctacagaaggaccctctaacgcgaataaagcgaatgacagcggcaccattaatatggcgaaactgcaattactacctgaaaaccaacaagatatgatcaaacaagttcttactttgacacctgcccagatccaaagtttaccaagtgaccagcaacttatggtggaaaactttagaaaagaatatataatctaagtaatcagagccatagcgtatcagaaaaccacacctaattagatggttcttgcatctgtacctcttatcactaaaagcggcactaaacttccaacattaaatgtttgccttgttaaatatatatttttgccttggtttaaattggtcaagacagtcaattgccacacttttctcatgccgcattcattattcgcgaagttttccacacaaaactgtgaaaatgaacggcgatgccagaaacggcaaaacctcaaatgttagataacgtggatctccgacacatgtgaatttataagtaggcatatgaaaatacagattctttccactgtgttcccttttattcccttctcatgtgaagagttcacaccaaatcttcaaaatataactaatatagtagagtttgattcaaaggacctttttttttgcctctttgattagtttatcttcttttcttcattttatcccctaattttatacgttagttcaacctaacaatccaggatttcattaacaagaaaggtaaaagtaacctatcaaggctattttgaaaaaaaaaattccgccctgaatatttcgagtgattttcttagtgacaaagctttttcttcatctgtagatgtccagttgtaaaaccactttgtctgaaatggttggttctgtgacaaaagataggggcactatcaacgtcgaagccagaacacgttcgagtaatgtaactttcaaaccacctgtaacccacgatatggtgcgttcgcttttcgatccaactttgaagaaatctctgctggaaaaatgcatcgcgctagctattatatcgaattttttcatttgttattgggtcttccaaaggtttggcttacagtttaccaaatacttttttctggtacagtatttattttggagaattgcttataatttaggtattggactggttctgcattaccagtcacattatgaaacactaacgaattgtgctaaaactcatgcgattttcagcaaaataccacagaataaagatgctaattcgaatttctcaacaaattccaattccttttcagaaaaattttggaattttattaggaagttctgtcaatatgagattaggtctaaaatgccaaaggagtatgatttatttgcctatccagaagagatcaacgtctggttgatatttcgccagtttgtcgatttaatcttgatgcaagattttgtgacttacattatttacgtttacctttctattccatatagctgggttcaaatcttcaactggagatctttgctaggtgttattttgattttatttaacatctgggtcaagttagatgcgcatcgcgtggttaaagattatgcttggtactggggtgatttcttctttttggaagaatctgaattgatttttgatggtgtcttcaacatctctccacatccaatgtattctattggttatttgggttattatggcctatcattgatttgtaatgactacaaggttcttctggtgtccgtatttggacattattctcaatttttgtttctgaaatacgtcgaaaatcctcatattgaaagaacgtatggtgatggcactgattccgattctcaaatgaatagcagaattgatgacttgatatcaaaagagaattacgattattcaagacctctaattaacatgggtctttcttttaacaacttcaataagctaagatttactgactatttcacaattggtaccgtagcggcacttatgttaggaacaatcatgaatgctaggtttatcaatttaaattacctctttattaccgtttttgtaacaaaactggtttcatggttatttatctcgacaatattgtacaagcaatctcagtctaaatggttcacgagattgtttttggagaatggttacacacaagtttattcctatgagcaatggcaatttatttacaattattatttggtattaacctacacacttatgataattcatacagggcttcaaatttggagtaatttttccaacataaacaacagtcaattaatttttggtttaattcttgtggctttacaaacatggtgtgataaggaaacgagactagcaatctctgattttggttggttttatggtgattttttcttgagcaactatatctcaactagaaagctgacttcccaaggtatctacagatatttgaatcacccagaagcggtattaggcgttgttggagtttggggtactgtattgatgacgaattttgccgttacaaatattatcttggctgttttatggacattgacaaattttattcttgtcaagtttattgaaacacctcatgttaataagatatatggtaaaactaaacgagttagtggtgttggaaaaactttactaggcttgaaacctctaagacaagtttcagatattgtcaatagaattgaaaatattataatcaaatcattagttgatgaaagcaagaactccaatggtggggcagaacttttgcccaaaaattatcaagataacaaagaatggaatattttaattcaggaagcaatggatagcgttgcaacaagattgagtccatactgtgaattgaaaattgaaaacgagcaggtagaaaccaattttgtcttgcctactccagtaactttgaattggaaaatgcccattgaactttataacggagatgattggattggtttgtataaagtcattgatacaagggcagatcgtgaaaaaacaagagttggatcaggtggtcattggagtgcgacttctaaagattcatatatgaaccatggattaagacataaagaatctgtaacagaaataaaggcgactgaaaagtacgttcaaggtaaagtgacattcgacacgtctttgctttattttgaaaatggtatctacgaatttaggtatcattctggtaactcccataaggtgttattgatttctacaccatttgaaatttcattgccggtactaaataccacgacacctgaactgtttgagaaggatttgactgagtttttgacgaaagtcaacgttttgaaggatggtaaatttcgtccattaggaaataagttcttcgggatggacagcttgaaacaattgattaagaactcaattggcgtcgaactttcgtctgagtatatgaggagagtcaatggtgacgctcacgttatttcgcatcgcgcttgggatataaaacaaacgcttgatagtcttgcttgagttttttttttttgagtatatatatttaaaaagtactaggattcaagttaacattttgaatagaagtagttatgttgttgtaatataatggagctaccatatatgcagaatgacattataaattatgatgttgatgtacaatgcctttgtgcgcttcttttaccatgaattttttcttaacctctttcacttttctttccgactaggataatctcgtgtctaagtttcctggttcattaaacagcttatcattaaatctctataacggttatattgctccttgcaacgatcaaggcattccaaaagatcttcatcgtcaccatcatccttccaaaaacctacaatttcctctccatttttgatgaatgatacgacagtgccattggcctcaccggcacctgccatatccactaattcgatgccggcatcagctaaggctagcgttatactagtgatacaatgtggtatgagagatgatatttgagaagacatcattttgctttgcgaatcgtcgtcctgaggattatttgtaagatccttatcatacgttaaataaacgaagatatcgatgccggacttggggtagcgagataggtttactactgaattgaaaatgcccattaaaaagctgctaacttccttcagttcatttgtgttatatttttccagaagaccgttctttaactgaatagatatagtaccttgagatgtgaaggatcctctaatggagcgtggtccatagacagcggtaatgagcgatgtttggtgtcctaagcttctagcttctactaatgcagatccattgcagttttcgatgaaaccggtatgtagagaaagttcctgttcactttcattgcctttaggtgtcaaatctgttgatttcttttctggcacatgagtagtagtgttgctaaacgccattggcttggcagcagcagggcctaataacctccttctgtcttgaacattcatttattctgataacaccttaatgtgagtatgttcctacttttaagtggagtatgtgctaatccttaaaggaagttttcgtggctcaatcaagcacaacgcccaagcttttatttagatattcatttcatattactgaaattttttgagtattttccaaggccttgtaatcttccgtatctagcgatctcatctcatcgtgaaaaaaaaaagagtaagccattcgaagaaaagttggcaaatagagatggtgaatgaaaggtttaagaatgtatcctatttacttactaatgtacacaaaatattatagaccaaatttttcctcaaaaatggaatatagtaattaacgtaaaaagagaaaaaattgaaattgaaattcatttcattttctcattaatcaaatgttttctttgaaccagcgaaagaagcggtatttcttgatctgcccaatggagcagtattagcaccagaaccagatggtctgaaaccgccacggccaccgcgagcgccaccacgaccaccgaatccacggttaccgccacgaccaccgccacgaccaccaaaaccacggctaccgccacgaccaccatcgttgtttggtcttggagaagagaagtctaatctaactggtctgttgtcaatgtattcaccttgtaaagcgtctagagccttcttggcgtcctccatgttggagaattgaacataaccgaaaccttttggttgttcagtttctggatgtgttgggatacggacggaaacaacttcaccgtgtttagcgaataattcgaaaatagcgtctctgtcagcattgaaagataagttacccaagaacaaagtgtcagatggttcagatggggtatcaccgaatttcttggcacgatcgttgttaccagctggcttgcttgtggacatatcacagttgattggtctaccatcaatttccttaccttgcatttcttgaatggccttttcagcataagatttgttttcaaaatcaacgtaaccataaccacgagatctatcggtacctctttcataaataactctggcaccaatgacaccaccgatgtgttcgaattccttcttcaaccattcgtcatcaatagaccacgatagtctaccaacgaaaatagtagctggttcttcggtttcttcatttttttgcttcttgttggaagactcttcgtcttcttcttcttcggcgtcctcagatttacgtttcttatcgttagactcttccttttcgctttcgctatcagaagatgaagatgaggatgaatcagagctagaagattcttttgattcttccttcttggtttcttctttttcttcttcttcttcttcgtcggaagaagagtcagaggaagaggaagaggaatccttggattcttccttcttggtttcagcttcactttcgctgtcagaagacgatgaagaagaggattcagaatcagaggatgaagatgaagatgaagattcagattcagactcagactcagattcagattcagatgaagatgaagatgaggatgaagattcggaggaagaggaagagacggccttagctttttcttctttggcttgtttggaagccttaacttccttcttgttaccttttactttagtagtcttagccatcttattttatcctgcctgggttgagtgatccgaaattggttaacagttcgtctttgggaagcaaaagtaagaaaaatactacgaaaggaaataacttaaggtaccaatggattgggaagtgcagacagcaacagctacacttaagtacttttaatattggattgaaaattttcgttcttgcgatgagctgcccttgcaaatttttcaccaaaaaaaaaaaaaaaaagaaatggagtgaaaaaagaaacgaaaaaaaagggcatggggacccatacatcaggcacttacccccaggaaggattacgtctttaaatcagaggatcaaagggtaattaacaaccaccagtcgaattgctgtcgtctttcttcaattgctttatccaaaaatctgaatggatgtaagtattgcccagtaagttttcttggcaaaataacctatagcgaaatagacaatcaacgtgatggggtttaaatagctagcggtaagtaaccactagtagaacgtagctccatagcgtgtaatttggcggcaaaatatgtgaagcaagcatattcgttattacttagctgcctgtgaaatcctgtctgtgccttctctttgcctttactttgtataaaaacatatcaacactgtctctgcgtatgaggccgaggtatttagagcataagaaaaaatgtgaacaaaaatagtgtcatctccagtaaggcttaaatgtatattgattttctatatatatatatatatatatatattatgaaataaaccatataattataagtagtagcttggaaaaacgccaaagttgtacttagaatgaggttttaaaaaaaaattaaataaaaaaaaaccaaagcgagaagtcacgcttataacgcaagtgcacgaactgcatatgtgttggattgccaaagatcaataggaagaatatatttagagaaactctgttttcttatgtatctcgcttacagcctatttcaatgaaccagtttggaatctctttgccatgagatcagcctttaaagagtttgagccatcgagactgtaattggaagaacgccttctcctgtcatgaagaagagcaccggattcggttaaatcgctagacgaaatgccgcttagagaacgtggannnnnnnnnnagtgtgatgtggaagatcggcggagggaaggtttctgtttgttgttggtgctgagtggattttagtctcaatggggaaaatcgtgtctgagatgcttgttccgttagatatggaagcgttccggcttgaccttctggcggaatgggaaatgtgggtcatggagtccttgggtgttaagggaagtacggtgtgtctggatgcaccatctgtgagctttagctttggagtgtcgagggtgtaaccataattgcagtcatcatcatctaggatggcagactcgccttcgaaaaatggagacgaccttctagccgggaccggatggtgcagttgattttttaacctagagttttcttcttttaaagtttcaatttcccgtagaagtcttactacaatagcgtcttgctccttttccatttcgtttattatttcttccctcgaaagccttctctgtgctgacattggtgacgaagaaggagacgacgacgtcgaaagtctgcgaggatcacgtgctacagctggtctcatggctcttgtaactgaagtttgtctctctctgcatggtttggcaacagccttcttgtgttttgattctttattcatgtttacggctctggaggtagcgatcattatactttatcttctattaatgctatgattgatgaattatacgtatgtatgtatctgtaagaaaatagccgaatgattgattatcttttcttatatatgattcaagggaacgaaaagaagacaagataatgttaggcaagatagttttttagacgactgaggccgaagataagctttatatatatgcaagtctatttttgtacgggcgaaaccatctaagccaacgataacaatagccagctatgatcgttgagtacagcgtggggcaatttttagcgtgattgataagggcgcattatctcatcatccatcgccaatttgggactctaacggcaaacctcggatttccgtggaaacgcatggaaaaattgatccgggctgtgaggggagtcgagtcagtcactttttggcaactctctccgtcatgaccactactccgcggtagctgccaaatttggtatttccaggttgttttttgtggacagcccgcgatcatatgtaagagcaggatgtgtcatccgcgggtgaggtaaacgctggcttgccattatggttttttggtacgtgttgaacacgttgcttacgatcttggtaggggcgggctgtgatgtgagagccacaaacccgcttcctcgttgtggctctggcgctccgtttcttctttcccccgccttgtaatatgtcgtgcatgcgtccatgatgatatcgtatttattgtatattgtggtgatttcggcatattttagcacatctgtagtataccacagagctaaaacaaccgattatagtcaacattatacagcattatgtctggatacttcaaccatctttcttcgaatgcacatttcgcaaatattcaagccgatcagggcttcataggtgatgctactggcacaagcagcgatcatggcagtagtggcatggttgattttgccctacaactcggagaactgagcctagaagagaaaatacttaaagagttcaccttattccagagcaagaacatggacttattgcaagagacggcgacggcgtgtccgagtactaatccttccttgagacagagccgaattcaaggctggtgaacgcctgatgcgagctatacgttttgtgctcaccgtgcacatatggtggctacttttctactcaaacacgtttgaaaaacggcatacgattagcttacagattgaactcaaagaagtcgcaatgggaggtgcagaagatgacgtgttacttagtttataatacaatgtgttttatatatcgattcttcgtttatgcatttctggacgattgcttttcactgtaaatacgcactaatattcatgaatataaaaaaatgtaacatcatatctcaatgttcttctccgtcagtcagatagtggcaaggctgtgataggacattcttagaacgccaagaaaatcaaaaatttgaacggtatctaaattcatttgtcgaacccttgaagaaactcacagagcggggtatctactattttgttttcgttcttttgaatctccgctacgtcacattttctacaaccctcaggtcccctcaccacgaaaatccaagatttgtaaaatatgagccgcgtatttctgcaatggtagaaacgataatgtacctatcgtacaacgatacattattttagtgcattataagccgcttgattcatgttgataattagcggctaaattgtagtagtcattcaaaataatcgtacaccttcatatagttatgaaaggggtataaaagatgaacgctcgttggccatgtcaaaggtgccttaaaaataacaatgcttgcggtagtacgtgtgcaaagtgtatattcgcatgagaggtgatcggaaattgctttatcgccccactaattctgattcttattcaaatatttatgtcacgtagcgagcttacttatccatatatcaaaggaaatccagatataaactcaaactaattcttctgtttccacgtaactagcattcacattgtagttttctagattacagcaatttatatatattgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtttatatagagacctggttggcctggggcaccaagttttcttccgtttggattcaaaggtacgtttaatttgggtattttctcagttaatgagttttccatacctaatttcatgtatttacctctttgatatttgatttctaagccaaggatgtcgtattgaatttcatcatcgctttcacctagatttataatcttggtatcgtattgcatcttgagttttgctataattcttttattcgaatttaagtccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatccacattctcttcatatatacatatattggttgttgttactactttagcttttttcctctgttcgtttcaagatctagcttgcaattatccctctaggtaataaccagcatagttgtcgtcgtttcatgtgacctattcccctttaattggatcaatcttccaataagagtggtttcgtggtctagtcggttatggcatctgcttaacacgcagaacgtccccagttcgatcctgggcgaaatcattttttgaagattacattaataaggcttttttcaatatctctggaacaacagtttttttttacttactaatagctttaaggaccctcttggacatcatgatggcagacttccatcgtaatgggatgatcatatgatgggcgctatcctcatcgcgactcgataacgacgtgagaaacgattttttttttctttttcaccgtatttttgtgcgtcctttttcaattatagctttttttttattttttttttctcgtactgtttcactgacaaaagtttttttttcaagaaaaattttcgatgccgcgttctctgtgtgcaacggatggatggtagatggaatttcaatatgttgcttgaaattttaccaatcttgatattgtgataatttacttaattatgattcttcctcttcccttcaatttcttaaagcttcttactttactccttcttgctcataaataagcaaggtaagaggacaactgtaattacctattacaataatgacagacgaaactgctcacccgacacaatctgcttcaaagcaggaatctgctgctctgaaacagacaggcgatgaccagcaggaatctcagcaacaacgtggctacaccaactacaacaatggtagcaactatacccaaaagaagccttacaacagcaacagacctcatcagcaaagaggtggtaaatttggaccaaacagatataacaaccgtggcaactataatggtggcggtagtttcagaggtggacacatgggagccaacagctcaaacgtgccatggactggttactataataactaccccgtttactaccagccccagcaaatggcggccgctggtagtgcccctgctaatccaattcctgtcgaagagaagtcacctgttccaactaagatagaaatcactaccaagtctggtgaacacttagatttgaaagaacagcataaagccaagctacagtctcaggaaagatctactgtgtctccgcaaccagagtcaaagttaaaagaaacttctgattctacttctacttctactccaactcctaccccttccactaatgactctaaggccagttctgaagaaaatatatctgaagctgaaaagacaagaagaaatttcatcgagcaagttaaacttcgtaaagctgctttagaaaagaagagaaaggagcaacttgaaggttctagtggcaacaataatattccaatgaagactaccccagaaaatgtggaagagaagggatcggacaaacctgaggtaaccgaaaaaaccaagcctgctgaagaaaaatctgctgagccagaagttaagcaagaaactccagctgaagaaggtgaacaaggagaaaagggccaaataaaggaagaatccactccaaaggtgttaacctttgctgaacgtttgaagttgaagaaacaacaaaaagaacgagaagaaaaaacggaggggaaggaaaacaaggaagtgccagtacaggaagagactaagagcgccatcgagtctgctcctgtgcctcccagtgaacaggttaaagaagaaactgaggtcgccgaaaccgaacagtcaaacattgatgaatctgcaacaactccggctatccctactaaatctgatgaagctgaagctgaagttgaggctgaagcaggtgatgctggaacaaagattggacttgaagctgaaatcgaaactacaactgatgaaactgatgatggtacaaacaccgtttctcacatattgaatgtattgaaagatgctacaccaattgaagatgtcttttcttttaactatccagaaggtattgaaggtcctgatatcaaatacaagaaagaacacgtcaaatatacatatggcccaactttcttgcttcaatttaaggacaaactaaacgtcaaagcggacgccgaatgggtccaaagcactgcttctaaaattgtcattccaccaggaatgggcagaggaaatagatctagagattctggcagattcggcaataattctagtcgtggccatgactttagaaatacctcagtgagaaatatggatgacagagctaattcaagaacttcatcaaagagaagatcaaagagaatgaatgacgacaggagatctaatagatcttatacatcaagaagagaccgcgagagaggctcctacagaaatgaagagaaaagagaggacgataaaccaaaggaagaagttgctccacttgttccaagtgctaataggtgggtgccaaaattcaagtctaaaaagactgaaaagaagctagcccctgacggaaagaccgaactattggacaaggatgaagttgaaagaaagatgaagtcactactgaataaacttactttggaaatgttcgatgctatttcatctgaaattttggctattgcaaacatatcagtatgggaaacaaatggtgaaacgttaaaggctgtgatagaacagattttcttaaaggcctgtgacgaaccccattggtcttctatgtacgcgcaattatgtggtaaagtagttaaagaattaaacccagatataacagatgaaactaatgaaggtaagacaggtccaaaattggttttgcattacttggttgctagatgtcatgccgaatttgacaagggttggaccgataaattacccacaaacgaagatggtactccattagaacctgagatgatgtcagaagagtactatgcagctgcttctgctaagagaagaggtttaggtttggttcgtttcatcggtttcctataccgtctgaatctgttgactggaaagatgatgttcgaatgtttccgtagactaatgaaggatttgacggattctccatctgaagaaactctagagtccgttgttgaattgttaaatactgttggtgaacaatttgagaccgatagtttcagaacgggtcaagcaacattggagggttcgcaattgctcgatagtttgttcggtattttagacaatattattcaaactgctaagatttctagtagaatcaagttcaagttgatcgacattaaagaattaaggcacgacaagaactggaacagtgataagaaggacaacggtcctaagaccattcaacagattcatgaggaagaggagagacaacgtcaattgaagaataattcaagatctaattcaagacgtacgaacaactccagtaatagacactctttcagaagggacgctcctcctgcatcaaaagatagctttatcacaaccagaacatattctcaaagaaatagccaaagggctcctcctccaaaggaagaaccagctgcaccaacttctaccgcaacaaatatgttcagtgcattaatgggagaaagtgatgacgaagagtaacatgaatagatcatgttaagtatcgaaaatgtcacttggatacaaggatgttggtagaaagtctaataaaataataaattaatagtacaacacaaatttaatcttacgtttaatcctgcgctattaattgaaaatatatgcatggagaagaaaaaaaaagtgtccctaatttaccattgttatattttctcgattaatgggctcatttcttttcactaaaagctataaacaagtttgatgcattttaatgggtaatcctcttactgtgcttttttttcctatcttgttctatatgtcaatgcctttctgtatttttatttatagcttcgccagtcttcgtttacgatatgttttatataatagaccactcagcatatgtatagttttgtatatttatatcatttattagctgacggctttaacttcatatttcgatttaatcatgctactgcttcaccatttgtccttttttttacagaggccacgaaaggaaaggaccgtttccggacaacagaaataataaagatatcagagcttaaactagtaaattggtaggaaaaaaactcccaatagaaccgattaacatccacagattaacaaaactccaggacaacggtactaatacacatacaacatgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgtgaaagacgtaaggcatgaaaatattagggtatatagatacatattgaaaatgatagtagagccaatgaccaaaccaagaaagcctacagtacagaggtgccaaagtttttttactaatggggcaaatcatttttattgcaaaaaaagcactcacgatgggggtcgaacccataatcttctgattagaagtcagacgcgttgccattacgccacgcgagctactgtttgttggaagttttcaattattaataagtacataccaaccttagctaacattactataacgacgctgagaaagctatacaaaagatttatcgatcgagaatcattgtttcttatttttttcaggaaggatgaacacattgttcagaatattatcaattaataatttatcgtacggacggtacaacagcaaaataaaatagaagccgaataaaaaaaaatgaaaaggaattctttgaaaagaaagtacatggcaaaaactgtaaagttacaaaaaagaggaaagccactccatacttttagtaatattcgattgtgatgagttacggcttaacaggtacctcttctaagctaagaggaactagttcaatattttcatggactcaggtgaggcacttttctcgtagaagaatagcctatccattttatccattcaagaaattgggaagacaacacccgaagaagcatgatacaaacttaaagactgctatgagacagtttttaggtccaaaaaattacaaaggagaatatgtcatgaacaagtattttacggttccgacgaatcatgtacctaactacattaagccagatttggaaaggggacaaagtttagaacacccggtaaccaagaagccattgcaactaaggtatgatgggacattaggtcctcctcctgtagaaaataaaaggttacaaaacattttcaaggatagattgttgcaacctttcccttcaaatccacattgtaagacgaattacgtattaagcccgcaattgaagcaaagcattttcgaagagattactgtggaaggactttctgcccaacaagtttctcaaaagtatggattaaaaattcctcgtgtagaggctattgttaaactggttagcgtggaaaacagctggaacagacggaatagagtatcttctgatttgaaaactatggacgagactttatatagaatgtttcccgtcttcgactcagatgcctcttttaaacgggagaatttaagcgaaattcctgttccgcaaaagactttggcgtcaagattcctcaccattgcagagtcagaaccttttgggcctgttgatgcagcccatgttttagaattagagcctgctgtagagaccttaaggaatttgtctactgtgggggaacattctagtggccatcaacaatccactaataagaatacgaaggttatatatggtgagcttgtcgaaggtgaaagatcacaatataaatttactaacgcaaaggttggaaaagtgggataccgttacggtagcggaaatagggataacaagaaagacagaagaattggctttaataaactgggccaaatggtatatatataaccactttttgtcttatgagtgctttcttgtatatgcgtatatgtcgtcatattttcagccattattacttgtacataaaatattctacataaatttatatatcccatgaaagagccatggtcacgttgggcacatttcttgaatactcgtttgcaaggcttatttttctgtcttttcacatctttctattttagtgcgagaaatgcaggacctatgaaaaattggtaacaaaaataattaaaagtaaatgctataaaattgtgggtaaataaaagtggaacaagagctgagttcacaactctacactctatatggacaatattcgaattaagcgcaattgataaatcacaactcattgaccatggaatgttttgtaccgctgcgttgcgacttagatggaagtaatatagaacagttacgtcaatcacacttaagccgtaaatttattatatttgatgagcaactgaatctttggctgtggtttcaaggtaattcgcaagagaacaagagatttgtactacagaatatgataatattaataaatgaagcgcaagttaccagaacaagcactatcgatgattattttacccaagttgagaacaatgaaaatctatggaggttgaaaaacgactgctgttcgaagattcttttcaaatcaaatgttgttatgaataatggttataataatcagatcaaatttgtctttgaatataaatctgtggatgcaaatttcaataaccaggattcattacaagatccacaggcaaagtatacattagataagtactctagcgaggagattttgccaagttttgagccagtttattcctggtcttctgcagccaccaaatcatccaaaaatactaataatcatctggagaaaaataacagggcgactcatcgagttagttctaaaaatagcgaagtccacgaagcggacgtttctagaaatccgaatacatttactcttaagctccaatacccaatattctcacttttgaatatgagattgagaaacatctccttgaaatctgagcattgcatattatcatcgttagactttcaaacttctaaagcatccgaacaactgaccaaaaaatttatttatccgcaagaacacaattcttttctcaaactgaactttcaagaaatatcgtataaactaatcgacggaacctctcaaattgaactagatccaatctgtcctttgaaagtgccactcactgcattttcatacgatagcattagcgctacttttaaactggttctgttacccaaatcaactcaaccacatcgtgtgaaaatcaccttagcgtacgaactcgagctgcatcccaatctgaagttacctgtgagaacatcatgggaaacagaagtcacattgaagcgttctatgccaatttcctcgacatcttctcaatactcgagtaacaacaataataccaatcatagcgcttcttttaatggtgcggccaacaacgttaattctggtggtttggccaatctaagattaggtggggtttcctcctcaagatttagtcttggagctgcttcgactacatcattggtgaatagcaaattaagcaatgtaaaattcaagtttattaatagcaatataaaagttattaagggcgaaaagtttactatgaggcttcagatcattaactcgtcatcatcccccctggatcttgttgtgtattataacaatacaataaacccaatcccttcagctaataacgtacgtaacagcaatggtataaacaactgtggcatgaataatgggactatccccaattcgcccttgacactggaaaatcagtaccaactgcataataaatatagaaaaattgcggaggggattatactattatccaacgattacaaaattccagttgtacctccgagagaaacatacttcgcggatttacgatttattggtattatgtccggatattatggcactctctccggacttaaggtattggatttaaatacaaatgaacttatagaagttggaaatggcgcatctgtgttaatccagtaagcggaacaagtatacattttattaacatagactacatactaatctgtaacatttctataaaaaagttattatcatcacattacacgatagaaacacttccatatttttttacactgaaaggggcacctagaagattaaacaactaaactgaaaatatacgtgctagaaaaagggttttacagctttacttaggcgttgcgagtcacccaaaagagcagttgaaggacgccgccgtttcactagatacatatatatataatgtcagagaaattccctcctttggaagatcaaaacattgatttcacacccaacgacaaaaaagatgacgacaccgattttttaaaaagagaagcagagatacttggagacgagttcaagactgaacaggatgacatattggaaacggaggcttcccccgccaaagatgatgacgaaattagggattttgaagagcaatttccagatatcaactccgcaaatggcgcagtctcgagcgatcaaaatggtagtgctactgtatctagtggtaatgacaatggcgaggcagatgatgatttttccacattcgaaggtgccaatcagagtacagaatccgttaaagaggatcgttctgaagttgtagaccaatggaaacaacgtcgtgctgtagagattcacgaaaaggatttaaaggacgaggagttaaaaaaggaattgcaggatgaagctatcaaacatattgacgatttttacgattcttacaataaaaagaaggaacaacaattggaagatgctgctaaggaagctgaggctttcttaaagaaaagagatgaattttttggtcaagacaatacgacctgggatcgtgcacttcaattaattaaccaagatgatgccgatatcattgggggtagagacaggtctaagcttaaagaaattcttttgagattgaaaggtaacgcgaaggctcccggtgcttaaatgatgatgaataataagaaccataatgaactaaggaagagaaggggcttattccctatcattcccgtcatacatgagtatcatacttgataggttcagtaaataactaattcatactgtaaattcatttatcaagacaactataatatagattatttacaaacttgtaaactcttctcttctaaaaaaacacatcacataatactaagctgaaacaaaaagaatagtatatatttcccaaagttgcaatgccaatactttttcaagtaaacattaaccaaggacttcgcaaagaattttgcgaaaaatgggctgattttcattttacttgttggatccacgaaggtgaatgtaagaagcatcacgatgcaccgcaatttgttgcccattaatctgcgccttttcgtgacgaataaatattcgatacactgccttaatatagtccattttagacttggaaaaaaacccttggtgaaatatgaatttattatcttttcgtttatatttgcataattatcatcaattgtaacttcatgtatttcatttagtctgtccattacatgcttcaaatttgatgaagatatgggccaatcattatggttcttgaccccaaggtattgagaaaagttcctgacttcgtggccgccgacattcttatttgatttcgtccctgaagtaaaaaagaattttaatgttctgtgatatactgccaaaactgtgaaaatggcattgattgtgaagaaatctattaaaaatggcctatggtcaaaaagcacacggaatggtaacgaactcctgtccagtttggcaaataatacaataatcgctaaacacacaagaatttgctggaattttattaatgtaccctgggaaaaatttttttttttcaaccattgtgttaattttgcgatctttaatttggaggctatagcttccacaagaaagtgtgcgataatccacgaaggtacctcacccttggtaagcattaacgatattcctacaatggaagaccagtgaatataatgattttttaaaaatgggaacttcatcaaagttggatatagtatgttcagcaagactaatatagtagactctcttagccatggcatgatatcatttatttgaatattttcaccctgtaattttttcaatttccattttttgacataaaatactaggtttattccatagacttgggttattcttttcaagatgatgacgagttgttttcttctcttcttgttcaagaggagtagaagccttcttattatctgcttgaagccagaaactgctttcccagtaccatttggacgattgtgtttcatatagttagcaagtgtatactctcattagctctgttcgcgatgtgtatttcgtggtgctttatatagggtttttaacttttccccatgaacattcgctgttatgtattcgcaactaaaaataatgtctctctttaattttaatttacatccaaagtacggaaatggtaactaaactatatacaaaaaaagttcgctcaaaaaaaagtttaactattgtccaattgtgcccattttggtaaatctgttttgaacttgaatttgccattaatctcctcatacttccaagcatgcaaccataattctaggtctgatagcacaggatcctttaaatcaacagtatgacattcaggacaaaatgtttccattgtccgacaattattttttgtctcatcgacaaatttttgaaacctcactttcaattcctcagcatctaaatcctgctgattctcccatctaggaaactgagttataaacttaagcctttcggggtattttgtaatatgcgaacaataaacactatcgttgacgatgggatgaccgagcctagctaaatggattcgaatttggtgtgttcttccagttattggcttacaagcgacgacagtttcatcagcatgagagaagtatcttattgggtagaacttggtaatagcatccttcgatgtcgataaaccaactggaaactgtctctttggatcgatagaatatatgggtgtcatttccactgtaactttggaagtgtcctcaaaagtcgtttccgccgcattttcattgtccaatatcaattcggagtgaggaaatcttcccttgacccttgccaagtagatcttaatcatatctcttgaacgaatactcttctggatttcccccgcactctgactgttcttggccaatatcaacaagcctgatgtgatcttgtctaaccgataacaaggaagagcatctacaccatgtaacttcagtaattcagtaattgtgttctggtaaaactgaccggttggatgcactggtataccactgggtttatcaatgacgaggatactctcatcttcaaaaacaatattgaatcccgctattctgccaggtaaatcctccgcttcaacttcctggctacaccattgttttaccggcggttcgtgcttatgcgtagttgtttctaaaacatcatgattcttgattatggtagtcatgagatgatctggtaccagcggcacaccatctcggatcaacctatatgtgcctttccttatttggtccaaataataagctcttgggcgaagtttaaattcactaacgagaacgtctattagtaacttacccaaccagcgccccttcacgaacgctgatcttctgttataatagggccgtacctttctcagtccattctgtgtatatacctcaataactttgatagttgacatacttgacaatcatccttttgcccactgattgtctcgagcaatcgtcaataaagttttcacaagaaacatttatttgccttttaatgaaagaaaaaaagtaaatttttcattaacttttatcattgttatcaatcttcttgtatgacagcaagctatatatacatacatatgcaaatctaatgtacataatttcaactattcataccattagtaccataaagtcattctttttactgtaaactacacttgcattatccttcctcgtccctctttattcttataacgttgaacagtgatttcttaccatgtgtatttttgtactcaacccgcaaaagataagcatcctcatacagaagtattattattaccactgttacttttattgtcgttatttgtcttgcgtttttatgtttatggagataaagtgggaatgactttatcatatgcaattattagccgctataaggctaagattcttcaaatttatttcatttttcttttacccttgccacccttgcccagttgctcctcctctgcggttagcaacgcatcgcgctcctttttagctcttgctttttcttgtcttttttgctcttcctctaattttttggcattctctttcctcgaaccttgttcccatttagaagcttcctccgcttctagctgctccatttgtgctctttgtttagcatgtgcctgatctctttttcttgctaagccagctgctttctttgcggcggattctgaaaatcttttacccatctttttacttcctctttgctattctattatttcctgtataggcaggttttgtgctcaattgataaattcttttacctattaaatataaacttgagtttcaacttattcagctttattttaaacattatacaagtttttcattttgaggggtctttaactggaaaaaaaagctttcacgactcaaagaaaaaaaaaatttttttagggtaaaaaaaaactaagggctaatatgaaaaatacaaaggttatgttactttaaaatgaggtttggaagaaggagaaagacaaaaaagcagggcacatgtcaaactcttggaaacttgagatcctagccctaacgcatgtgctacttcaaggaattcttcttatatatgacaactattccaatttgatgctaaaactagcccaaagtggttgatgctgtatcaattggtaaagaatcctcgattttcaggagcatccaacgacgaagatgaggattattaagggcagaaagcgaggcaagaacaagaagccaacgctaattttaaaaattcatgtcattcaagctgaaaatattgaagccttgaagacattcaattgtaacccggtatgttttgttaccactaatacattttatagtcaaaagacgaacaagctcaagaactcaaatacacactggaatcaaaccttgaggatcaaacttccgagaaatccaacatctgaatggttaaggattatagtatacgacgccctaccaaccggagctccccctactacccccagtagaccaaggacaaccactgcaaatacatcttcatcgacactgtcaaattcagggctaagttctcactctcattcgtcgagaaatttgaatgttacgtccaaaggtaatcaaacttcaacatcaattaattcagtatcatcttcagctacaccggccccttcacattcttcctcttctctctcaacaacaggtcccgggtccacacacaaaaataggattaatagctatctatatttgggtgaagcaaaaatttcattactggatttattcaagaggaaggacaccacgacgagctataaattttcaattgaagctcagcggtaccatctatacgatatgaaaggagggaaagaccaagattccttgaactgcaactttctagtgggcgatattttgcttggatttaagctagaatgtaacgttaaaagaaccccgacttttcaggctttcaatgcttggagaaatgagttgaacacttacttgggcagaatagatagaaataaggcccgcatgagatcttctagttctttgccacctccactagaagatatgttgagcaatagttcagctgttagtggaaatgaaatacgacgcgagaaaccatatagcgatactgatctagcccacgatgaagaggtcaatgccgaggatgaaatagatgctgaggaatctattgaagatatgaatagcagcggcagcatttgtacggagaggaggtacgatatagacaatgatactatattcgactctatatctgaggttgtttcgctaaatgatgaagaactagatattctaaatgattttgaagaagcagatcatccaaatgtgccagacataaatgtgcatgacatcgacgaagatacccgtatcagtctatcttcaatgataacagctttagatgaatatgatatcgtagaaccagaagatgttgcaaaattacctgcagtgtcggaaaatgacataacatcagtggatgacgaagaatctgaaaaccaacaggaaagtgatgaggagtttgatatatataatgaggatgagcgtgaagattctgattttcaatcaaaagaatacattgggagtcggcttttacacctgcaaaggggtaaacataataaatcatatgcaaattacttatacagaagagcaaaaagtaacttttttatatcgaaaaaggaacatgcgatgggggtagtatttatgcatattggggctatcaaaaatttacctgcattaaggaatcggttgtccaagactaattatgaaatggatccatttatcgttatttcgtttggtagaagagtattcaagacatcttggagaaaacatactttaaacccagaatttaatgaatatgccgctttcgaagtttttccccatgaaacgaattttgctttcagtatcaaagttgttgataaagactcattttcattcaatgatgacgttgcaaaatgcgaactggcttggtttgatatgctgcaacagcaacaacatgaaaacgaatggataccttatgagataccattggatctcactgttgagccagcacatgctcctaagcaaccggtattatattcgagcttcaaatatgtttcatatccgttcttaaaaaagagcttttggaaagaagctgttgacacatcagtcaacttagagagactcgacattattcaagtaatgctctatcttgaacgtcttggttcattcacgatggccgattcttttgaactctttcagcatttcaataaatctgcttgggccggccagagcattactagatcacaattagttgaagggctacagtcatggagaaaatccactaattttaaacgcatctggacatgtcctagatgcatgcgttcatgcaaaccaactagaaatgctagacgttctaaactggttctagaaaatgacttgataacccattttgccatatgtacgttttcaaaagaacacaaaactttaaagccgtcgtacgtctcatctgcatttgcatccaagagatggttctctaaggttttgataaaattaacttatggtaaatatgctttgggatctaacaatgcaaacatcttggttcaagaccgagacacagggataattattgaggaaaaaataagcgcacacgtaaagttgggaatgaggattatatacaatggtaaaagtcccgagtctaaaaaatttagatccctcttgaagactttatcaatcaggcaaggcaaaaaatttgacagcactgcatctgccaaacaaattgaacctttcataaagtttcactcgctagacctttcacaatgccgagataaagattttaaaacattcaatgaatttttttacaggaaactaaaaccaggaagccggctgcctgaaagtaataataaagaaatattgttttcaccagcagattcaagatgcacagtgttcccaactatacaagaatcgaaggaaatatgggtgaaaggaagaaaattttctattaagaaactagccaataactataatccggaaacatttaatgacaataactgcagtattggtatatttagactggcgccacaagattatcaccggtttcactcaccatgtaatggtacgattggaaaacctgtatatgtggatggagagtattatactgtaaatccaatggccgttcgtagtgagttagacgtctttggtgaaaatatcagagttattatccccatcgattctcctcaatttggcaaactactgtacatacctattggtgcaatgatggttggatccatactattgacctgcaaagaaaacgatgtagttgagagtggacaggagctgggctattttaaatttggaggttctactataataatcattatcccgcacaacaacttcatgtttgattccgaccttgtgaaaaactcttcagaacgcattgaaacgttagtcaaagtcgggatgagtataggacacacatcaaatgtgaatgaattgaagagaatccgtattaaagtagacgacccaaagaaaattgaacggatcaagagaacaattagtgttagcgatgaaaatgccaagagtacaggaaatgtaacatgggaatatcatactttacgggaaatgatgaataaagattttgctgggctatgaagccgccgaaaaattggctgtagttagtggttaccaaaataggaaaaaaaaaaacatgaacaatctccctcagactttattatagactatagcgtgtacaaacaagtcatcgttgataatgaaagcaatggtttcataccaggaaatttcctatgaaaaatatgcatttttattagtaacaaaagaaactatattcctagtcctcttgcagaaaatacgatataatacttaagttaatatttacagtgcagtaagtacctttttcatgacctcatattcgtttgttcctcttgcaacctgaatggaatttttttcaaaggtacttctcggcctttcttgttagattgctttccatatgttttatcggaacccaatctagcataatttatagtccttttctcctttgaaacatcaatacgatctaggaaactttgtgagagagatggtataatggattggcataaaatggagaggattctagacgtttccatagccaaaaatattatattgtcttgttgatctaattccctctcccaaggtttactattttgaaccaaagtatttgcatcgttgataatactccaaacatgccttagcagttgaggatactggaatatggctattttttcgtcaaaaacctcttgtgatttgttgagtagtttagccagattctcaattcgttcggagactattggttcattttggaaaatctcctgaaattgaaaatttgccttgtcgctaaatttcataacagctctttcaatattgaatttcgagccacaacatctgttaatcagattgccccatttggatactaaaagctctcttgtctcgtataatttggcttcttgaaaatcgccgtcctcttccagtttagaattttctaacaagaaccaacgcacaatatcggctccataataacgtgccatatcaatcggatctacaacattacccaaacttttggacattttcattccattgcagagccagtgtccatgaacaacaatttgtcttggtaaaggcagtccagcagccagtaaaaaagaaggccaatatacggtatggaatttcgcgatatcctttcctatcacgtgaatggtgtttcgctgcacttcttttgggtatggtattaacaattggccttttacgtttgatttgtcgctataatgtcttgaaactacttcagtagcattactcaagatggacggtatgccaccgatggaggagaggtagttacacaaggcatcaaaccacacataaactttttgggacggatcattaggagtcggtataccccatttaagtctcgcagagggtctcgatatcgataaatctggcaatgtcccaccggtttctagttcttttagaatttggtctcttttagaagcaggaaaaatgaaatctggattctttcttatatggtcaactattttcttgttaaataaggatagcctaaagaagtaatttgtctctgactgataaactacttcgtttttcgattctgtattcagatacttaccatcatttttggggtctttaataaccttggattcaggatagaatgtttcatcagaaatggaataccaacccttatgttcgcccatgtaaatatagccatttttcaaacaaagttcccataatttcatcacgttttcaatgtggtcaggatccgtagtccttataaatcttgtataattaatgccatatattttgtctaattgaacaaactctgggtatagcttatcgacgaacttttttggctgatcgaagccattgctttcactagcacactggattttcaatccatgttcatcagtacctgtggtaaagaaggatagattacctttaaataattgccatcgatggtaaacgtcacttaataagctggagtaaagatggccgaggtgcggtttggcattgggatagaaaattggcgtcgttacgtgggagaccttagagtacagacgatgcacaattgatcgacattgcatgttttctttcgatcaaaacctatgctttccttatttacctctggagaatagtaacattaaaatttacattcttttttcacagttgtgcggatttatttgtttgaaaccaccattggactacgttttagtttttaaagaaagagaaggcacttcgtaatccaatgttgcctagtactggtattgcttgcactatacaaggaagtaagtgtgattatgtaatgctgtatacactctttattcaaacatagttcagaaaaacatatatacaaatatcgcccctaagccaattcccttcagacaaaaattaccatgagggcaaaaacactgtagaaaatcaacagtgggtaggcaattagcaatcttgcattttgcaattggagcaaagaatttaaaaatccagacgaggtccaagtactccaaattacaaatagtactgatacaacataacctgtagtgttgttcaaaccatggaaaatgcccagtaaagaaaggaaacacagaggcaaaaagcagtatcctaagatggacgctgtattgaaaaattgtaggttcgtttgagtggaagtatcgttattgctcattaatttcgatagattgtgcaaagaaatggtaccaaacaaagcgacaccatagatatatccaaaatgaacctttccagccatcaatagaaaaagtccgaataacaaaaagaatatcaaaggcccagccaaatctgaatcgtttagaatttcttgtggcacaccactaccaaaacgtattggtataagaaccattttagttttcgttatgatatgatcgaaatttattccaatttcctccagtaatggaggttcatgtggatatcccttagttgaaagagcatgtaaaatacctacaggcaaagggtcgggggcaacacccaaattgttatcgttgccagtattagaagaaccgacggtattttgaaaactcattgacccttggggaacggcaaattgtgcagaaggctgataaaagccaccgccattattagcattgttactagtattgtagaaagacatctcgagagggactaatagttgtcttgcagtacttcccgtccaatttgtagctgttataagatgacttggttcgtgtcacgtagttacctcactcaaatagcaaaataatcaatggttacccgaagtgaaaattttcgtgataatagcgatgagatttaaacccagttataaaagtcgtacaatattgaagctgttgatattggaattgaacaagtactaacgagatacgcattatcaaaactaacgtaacaagcactacaaaatgggtattatcgacaaaatcaaagccatcgaagaagaaatggccagaacccaaaaaaataaggccacagaacatcatctgggtcttttgaaggggaaattggctagatacagacaacaactgctagctgatgaagctggtagtggtggtggaggagggtctggttttgaagtggcaaaatcaggtgacgctagagtagttttaataggttacccctccgtcggtaagtcctccttattgggtaaaattaccaccaccaagtctgagatcgctcattatgctttcacgacattgacatccgttcctggtgtattgaagtaccaaggtgcagaaatccaaattgtggatcttccaggtattatttatggtgcttcgcagggtaaaggtcgtggtaggcaagttgttgcaacagcaaggaccgcagatctagtattaatggttttagatgccacaaagagtgaacatcaaagagcatctttggagaaggagctggaaaatgtaggcatcaggcttaataaagagaaaccaaatatttactataagaaaaaagaaactggtggcgtgaaagttacgtttacctcccctccaaagaccaatttaaccgaacaggcaatcaaaatgatcttgagagattatcgtatccataatgcagaagttctggtaagagatgaccaatgtacgattgatgattttatcgatgttattaacgaacaacatagaaattatgtcaaatgtctttatgtgtataataagatagatgcagtatcattagaagaggtggataaacttgccagagagccaaacaccgttgttatgtcctgtgaaatggatttgggattacaagacgtcgttgaagaaatttggtaccagctgaacttgagtcgtgtgtatacaaagaagagaggtgttagaccagtatttgatgatcctctagtggtaagaaataattccactattggtgacttatgtcatggtatccacagggatttcaaagataagttcaaatacgcattggtttggggttcttctgccaaacattctcctcagaagtgcggcttaaaccacaggattgatgatgaagatgtagtttctttattcgcgaaatagtataaatgaatagattttaaagaaacatgaaaaaacaagatcagcatcgagaactgtagtacggagcagagattttgcatgactaaacggactcattttccttgtagtagaaataaatgctgaaaataggttttttagtgagaaccggaaggtgttactttcatggtatattcgtatatacttttataatgtaatttgaagagctccgttcataaaaattgtcattctgggcttcaaatgaataaataaacccgaatgacaatgaaatctcgaaattataatagtggtacctagtgtagtaagtataaaggaaccttctctgttgtatctcagaatgggatacctcagtatgacaatacatcatcctaaacgttcataaaacacatatgaaacaaccttacagcaaaacgaacagaatgagcaacatgaaaataaaactctgccttccttagctaacctactctaacgtataagtatctgaacaattggtttagatccaagattccgcgcttccaccatttagtatgatccatattttatataatatataggataagtaagatcccgtgaatcaagctgataaaccgttttgacaactggttacttccctaagactgtttatattaggattgtcaagaaccttgacattaccccattgcatgatgcaataatctcatataaataacaagcgcaagtggtttagtggtaaaatccaacgttgccatcgttgggcccccggttcgattccgggcttgcgcaatgttttttccatccccaagtatgggaactaaaatagctaaaaataagtatgaagttatatttttaaacctatttacagtgtacaaataaataatatatcataaatgacacagacgtatgttttaggatgcaaaagttcaagctgcccttcctaattgagtgacccgacccatctaccagaagcgccaccagcttttaacctgcttatcctggactatttcctttgttttctcctccgtttcagatcttagctgagacagttcatttctgatcctagccaactcttctttttgcacctcctccgccctcaccttagcaaagtgatctctgctttgaacgttatcaccgttcctttcccaaggtgattgaagggggcccgtcttccaaattggatcgtcactttgagaagtttccttaacaattttcatcaaagcctgctgctccgactgacgtagttttttctccctctcatattgtaaacgtaattctggggaaagctggctgattaactgttgatctgttggcgttgtgtacttgaaaagcagaaacccgcttccaataatagcgccaccaattgcatagactttcaaccaacgtacccacaatggtctttccatacccaaataatgcttatactgtctttgttttgctattactgcctctctaggagttatcgcgcactgcatgtatataaaattttatcttgataaaataccccgggggatgagcaaaaaaagggatatggggaatgaaaagtgagataaactagcaataatctattctaataagtagaacattcacaaagactactatggtgtaattctgaaaggatttacgagagcacaaatactattatgtataattctgactgcagaatccggcaagcttgatttaatatcacttaaggaagtaatatcgttaattgataaccgaatatgaatctcaatgcatattttgaagcatatcaagccatttttccttttctgttggaggcatttttaaggaaagaacaaaaagtataaaacacttcggttaataataaatgatatgtgaatttttttgaaaatatgtaaaataaataagtaataaataaaaataagatgtgtttatcgtaatgtactatacaagccttccaagccgacttctgtaataaaaaaaaaaggtgcagcttaatgtttgacggttcctatcctctctcccttataagctgtagttaaccaatcaactcaccaaacaaaaatggggtgaatactctaatagctgtgatcaaaatcataataccttccaataaagccattggtaatcccaagaaaccacgttcttccatgttcaagtaaatggtgtaaaaagcgacagcgaagaaaaccctggtcaattgcaaaggctttggcaagacaccagacagaaattcaacgggtttgttgacacaatcgccacctctttggaaatatttgaaacaacctttttgtaatgccttcaagttatcgctgtcagcagcgaacaaagaatacaaagccactgacaaaacgttaataacggaatcgtaactctttctttcgaaatggtagtctagtaattcatccaaaaccttttcacggtcgctgaagtctaggtcacctattttcttaatcaacaagacaacatcatgcaaaccgacagtcataccaccaccagtcaatggatgtctcatatttagagcgtcaccgataacacacataccagtgacgtcgttttgtctagctggcaagtaggagtttggcatagctctaaatttaccttggctgacggcttcatcaaatgaaggacgtagactctttggaatgaaaggttggacatccttaatcatccaactcttgatatcagctgggacctttggagagttgtaagcacaaaggattcttgtttcttctggactgatttggtaaaccaagattggcatatgatcactaccaagaataacgtgaccgtgcataggagcaggattcttagcattgaacaaagacataccgacaaacgaagaaccgacagttggaacatggtctgggtgcaattcctttctgaaacgtgaaaagataccgtcacagataaatgtcaagtgggctttgaattccaccttgccacggccatcaatgtcaaccttggcaccaacaacctcattcttttcatccttcaatatctcaatacagttaccttgcactctagtaacatttggctcttgagcagtaatgtttctcaagttgttcaagaatctaccatgaacaaaagcaacacccctttctctttcatcatcttcgtaatccttgatgtgaatagtgctgtcttccaagaccttgtcattaccatctttgaccaagtccttcaatttttcaactttagggatatcggccttgtaagggtatggaatatcaacttgttcgccgttgaaaaagacggtataaccggtaacaggatatgcttcgatgttgttgatagattgaatcatacccagacttctcaatgctctaacaccacctggttgcatcaattcaccaacaattctatcaggcatagcccagtcacgttctacgataagaactttcttaccctttcttgctagaccagtagcaacacatggaccgataacaccagcaccgatgacaatcgcatcgtaggtaattgtgttgtcggcattaatcaattcaggtgcaacgttaacagcagacatgacccttttctcgatatgtttttctgtgatttttttttttcaattgttcgaaataacctgtattgttcaatactggacaattgttctgatatatatatatatatataattttcaatgaagaaaaaaaaaaaaagaaagaaaattagaagctagaaagaaataaggaaaaggaaaagcaaacaacaataggaaaaaaaagcatagaaacatataatagattaaatacaaaagatttattatacatgcgaggtaagactattgtctaagacttatacccgaccgagagcagccacggcatgcatcgactacgagcgtattgtgttatatcagctctgtccgatacactgcttgccttttgtacgagctcggccgagctatacgaaggcccgctacggcagtatcgcattaaagcgacgcaaattcgccgatggtttggtagaagagcttgcagaacgattcccattcgccacgatcccgtagagtgccctgaaccacgctcatgtccatgttcataccattcacgtttgtggagcaaacgtttaggccgaacgcaaatctcaaggcgcctgcagactgcgagaagattaaatcccgaacgtagtacggcttggtcgtatcttgcgagacaagtcctgtattactgatgattgcaccgcctctttgctggtgcaaataagagttggcaagaaggctgtctatattcttgttttcaacgataaaatcaagttgtaggacccccagaccaatcaagtggtcaccgttgtcgtacgattctaaaaagcggtcatagtagtattcgacaagactccaaaacttgtcattgtcaccttcgggaatgtcgaatgaggagattagataggcgtaatgcgaacctccaacgttggagccgtatttataagaatctcttaactcttcatcgtttggtaaaaaccttcttgcgttgcttggaatagccacatcgaacccatactcgagaagagattttgtgaacagcttatccagtctatacagggctacaagaaagcacgcttgaatgaagggtgttagggtgcacccatcgtgaacatttttcttgatctgagctctgatttgttctacttgcttagtactgaaatgcaacaagtaattgtaactagcattagcattactagaggggctatatctagctgtaagtgtagattcgctggaggttttaaaattacaatgttcataaatgaaggttgttaaaaagaatttgggtaatgaagtcaatgctggcttgtagtcaatacgatccgtaatcggttttggcaatttagaaatttcagtgtagtctcgatcatagtcaatgatgacttgatcttcgatgaactcttcatcataatcaaaccctttttcttcgattttacaaaagagtagagctaaatctttgaaaaaattcgatccactgacaccgtcggagccgcagtggttagtgacataaacgaagtttttccacgtttcaaacccatcagtatccttacctggtaaacaaatcaatctccaattaggcctcttcggattacccagaggtatgattacagggctaatcaattcgattaacctattggtgactttgaaatcatcctttttgaactgttctgagattttctccatgacttctctgtattctggttgattattcataatcaagtcatcgaattcaagatgagaaatcacctttatgaaatcatgctgtggaaaaggtttactaaggtactcttcgctagagtagtacgcttcatgatgaggataatgcttaggaatgattgtatgcgcaagagttgagtatttttgaagtaatactttcaagacaagcattagttgtctcttattaacacctttattcaattccgcgtaaacagtaaaattcgagtacattttctgcctactcaaaacagcaaagtagttttccaagtggcccatacgtcttgcatggccacggtctatcaactcttgagtgatatgtggttcgtatccttctatatcttccataattaacctggacaatttttattgctgaagttattattcgtttgaaagtctcagtactgtttgtacgcattaggaatgacattgctgttactgcagaattgccctacacatttgttgttgtcttttaagtaacaatttgctctattttcacagacctcgaagaaacgtaaatcttgacaacaaatgtttacgatcgtttaggtgtatgaaaaaatatagaataccaaaataggaaactcgttgaattcgtttactcattatcccgcaatatttatcggtggcctacagagttcaatgtagcctgagattgtggcgattgaaatactgattacttaaaatttgctaaagcctgttctatctgaagaaaaaaaaaaaaaatggatgagccttccagttcattgaaattcttcagttcttatttttttttcaaaaagaaaagtttcagtaccctgttccaaaaaaaatgaaaaaaatgaaaatccagtatccttcccataaaaattaaaagttccattatttatgggtaagtaagtaccactgattatataccatatttataaagtgcatgaatttattactatatattgctttttctgacgtgcttccttcactatttatggccactggtactactattatggtggccatggtggctagtttgatggtaatttctactatggccatgactgtgcattgccgacccgttcgctggcatgccagatggacctgatcccatcattccttggaagggtatccctcctggatacccgaaggcacccataggagcgccagggccagctgccataaaacctgcagggacatggggcgaaatatttcctcctccttcttcagccccattgctacccataactggcatcatttgaggcatagatgggtgataaaacattggctgaggttgaaatggcatgtacatacccattgacccagcagcaaagccattcatcatcggatttggtgatgccgatggacctcccatcggaaagcccatcatcccgcccatattcatgcccatagctggattcataccaggcacagcattgcccatggagttcaattggcgttgttggaacctagtttgagcttcttgaatcgccgtatcctcatctgggaaaaatgtcttatacgattcttcaattgtatttaaccaggttggcgcagtaaaataaggtttttcaataaagaagggttccatattctccgaggcatcatcgcctttcttcttttcatcgtgggcctccttggatttgatgaacatattaaaactttttccgaacaacactctcttggcgtcattagtatgagggttcttggcaccaaaaaaggaaccatgattacgtcttctcaatgaagtactagatctcgtggtatggccggtagatgattggccttgagatatgttgctgccacttcttctagattctgatttccctgcagaaatctgtgtagtaggagaaacagtcttggccgaaggggttttgctgatcggttttggaggcaacgaagaattagattttaatgtagagcttgacctttttaagacttctagcatgtcttttggaatatcatatggaactttaaatttctcggaaaatttcttcaactcttcaatctgggcttctttgctactcaaacttttcttattcttagaagtcttttgtgggggttttccctctggcgcacctgctgctgcgggagtagaggtatccgtggaaacggcattttcatttttgttagaattactcgaagagataattgctggatccatatgatgaggttgctgtcttaaagtaggtgggacatacctattccccttgttggaattaggcttagaattgctttttaaagcggccaacaactcatctcctcttctatcaacaccagagtataagtcttcttcatctagaccagaatcatcaattatgatacctctgtcctctgcaatatgaatattaccggaagttccttgcgattcaatttccttagcgattctttcggcttcttgcaacctcttactgtaattagggtcatccttgttaatctttgttgtatacaaatgttcatcaaaagttgactttacgccaaactttttctcgttcacagcaaattgatcccaactggcagaatcgtcttccaaagctttacccttgttgatatcaaaatgttccgcgccttcttcgggtgtccatttttctaacttacgctccttaatttctctaccagaaccagaaatatcaacatcagtcctgaatttcgtaacttcattcgattctccatttaccctttccttttcaatatttgttctggcgggcgttgtttcttgggctttggaattttcccatttctcatcaagagacaaatcaatattcttcagttccaactcagcgacatcttcaccgtgaatcagcaaggtttctcccaaagtcttagccaagtcatccacagaatcactaactcctgaatcagcaaccctgggaaatcttaatacaacatcgataccattagtagattccaaattacaagatactaataaaccggtatatttcacacctgaagtaacagttactgttacatcagagcctatactattggctaacaaataatcttgacggtcatcaaagtttctcgtaatttcagggttctcatagaacattgaactgttgttttgattagggacgcctccattcgtataattgctgtcagaattaccaccctttcttgagttggtggagctatctcttttcctaaagtttcccttcatattgtttcaatgtaatgaactcctttaattacttccgtgactgaggatgtcagtttttatatcaaatcaattttcaaagatttaattattgcttccccttcaagatcaattcggaaataatcgaaacgtcttctggaaagaacaaaaagaaagatagaagaaaacgcgagtgaatgacctatatcttccttaaagatctatgcgatgagagatgccgatttaagaactgctttacaaaaacgcaaatctcaagtaaagaaagtgcctcccaattgagctttccttccttctttattttttttccagtttttcataatttgttgtggctctccaaggttttctgaggctcgttggcggagaagttacgtaacccggatgctaatagtgcatgattatatatcaaatatttagttatatgcatcgtaatcgtaaactctgaaacaatggattatcgctagtgtatatcttcttcggtcttatcttggtgcgactcatggtgcggtacaaaaacctctttgatttcttcttcatgtgaatccgaaatcatttgacccattgtttccttaagttcctttgatttcttcgtatattctttcaaagaaggtaacaacgacagtacttcctccttatcaagcctcacatcggctgtactttttatggggtcgttcaacatcaggttcaattcgtggctatcatttctaaaagttactgggccatcaggatgcataaatccattagtagattctaagccatatgtatattccattgctttgttaagtactggatgcagatctttttgtattagcttctcagtgagtcgtttcttgttgtttgtttttaaattcatgcacaacttcctagtttcctccaaaaggttttgttcacgtgaaagaattgcttccaatctctcattattttgtagttcttgtgaataccggttttgaataaattgtcgcttagaataaatatactcgatgtctagatctctttccgatatcctagagggaaatttggcctgtcttagcttcttctttatctttgtgaggattatttcaagcaaacgttccttcttagaatatattcttttaacctcattattatcgccatgcgtcatttggttcatttccttttcgtacttctcaaagacagaatcaagagcgcttacagtgttagtctctaataaacgaagtatggatcctatcattattttagaaggctttttccaatgctttaattcataattgcgcggcaacctttctctatactcagcttgtattaccttcctgaattcccaaggtcgtacattgccctctccacttgttgcgcttccatccgatagatgagattgcaatttacctgtactttccttgccaacctcaaatcgaagttgtttagatcctttatgatggtattgtccttcttctttgttcgtgcgctcttctatttctccttcttcagcatcatcagagttctcataaaaaagcgacttctttgattgggtgcttttagcttctggtgctacgtccagacgtaaagttttaatatcattcacattcatgagaatgctgctatcgctttcagaggaacttcggttgggtgacagatccatggcctggccattgttaattgaatcattttcaatattttgtaaaaaattatctctatcagctgccatacagtatacgtagcactagtatcgcttgaattattcgtccatagggtgcaagttacctcatccattgttgctatgtacctctatctgtattaacttcgaggtagtaaacaaatgggtggaccgtattgtgactctccgggtaacaaaaatatgttatttaaatgaaatgaccgggatgatggtactctctgaatctttcccttatctacctacaagaaaatggcaaatattgtcataataaatataaaaaaaaactgtagtttctttttaaatttttctacttaagtttagttatactgtacctaggtatatataaatatatataaataaaagtggccaagaataaaagaacgcaccccgtcgttgacttagaagtcatcatcaaagttaatttccttggatggggtagcggacttagacatgtcactggccttttggtagtcggaaaccttcttttcaaagaaggtggtcttaccagcggtagcgacatcctccatgaattcgaatgggttgacggcgttgtagtatttttcgttaccgaaaccttgtaatagaccgtcagcgacaaattctatgtaggtgtgaatgctcttcaaatccataccaaatttttctactggcaaagagtttgagtagtattccttttcaatttccacggcttcggtaatgattttttcaatgatcttggggtttggcttggttctcaaatgggcaaatagcaagcatgaaaagtcagtgtaggcacctctgtctctacagatgtttctgttggccattgctaaacctggcataatctttttgtcagtcaaccagaacatagaagcatagttaccagcttggaaaataccttcctttgcagcaaatgctactagtctttcagcatacaagctgtcatcgttggaaatccatctctcgatgaaagcagccttatgcttgacttcaggcaaattggcaatttccttgaatagagggatgttcttagggtccttgaagaaggcatcaaccatcatggagtaaacttcagagtagatgttttccatcataatctggaacccgtagaaactcttaccttcagggttttgcaattgggcagaaaagttttcgatcaagtacttgttgacaaggttgtcagaagaaatggacaaggctaacaagttaccgatgtaggtcttctggtcatcagtcaatttttggaaatcttcagtgtccttagccaattcgatttcttccgcagtccagaaagaggcttcaaccttcttgtaagcagcccagatttcgtggtatttgatagggaacatcacgaatctacggctgttttccatcaaaaggatttcatccttttcagcttctttcatatcatgacgttctttttggaaagtcttcaaaaattggttatgtgcttccattgtaataactaattgtgtgcgttgcgcggggttgtgtggctcaaaaagatctgtttttgtattagcaattttttatttccctttttaaatgaattttttttctttctgtttcgagacaaggccttttgacaaaaaaaaaaaagtaaaaaaagtgaaatttgatagtgtaaggggacagaggtggggtcagaaaccaatgtatctattgatagtctttttttgatcgaaaagccaagagacaaaaaatgaagaaaatgagagataaggaatgaaactttaggaacattgaagattcaatcgccgtttttatacgccagagcttcatgagaccaaggaaggaacggacgtcgtctaccgattacagtaagcaaagaggatggtgttgccacaacaacgcccatcgggaaggcaagagacgctgtggtgaacaataactgccaaaacgtggttctcgcacgctgaaaagcgcgttctcgtgcgccgctttcagtgtgctagaacttgcactgtccggtttccggtgcttggtgttgggtggtcgtacctgctagttccattggtgcggtgtatgggcgggtaccctcaaaaagggaaacgaaggtaggcgcacggtgcttattaagctcagaggcgacctcgcagaagggggcagaccacacaagcggtggaggcgctccagatattcagtggagtggggcttgctcatgttctgttgttggttttggatagaaaaagagcgggttgaatagtttgccatggcaaccactctggaagcgaaatcacatagacgcgtaaacactcacacacaggatattcgtatagcaaggtactagtggcgacactcaggtggtcctcgttgccttatctccagattcctcaatttctgtgaaacgtaaacattatgggaatagtctagacgcgtacttcattttctttgtttcgtgaaaagtacactttcccgtcttcgccggttccctttcttgcctgaaatgctcgttctaatggaaaaaaaaagaaataaaggtgggcctgcccattagcaggaaattggtacttaattattgaaaaaaaaattattggttgctaagagattcgaactcttgcatcttacgatacctgagtattcccacagttaactgcggtcaagatatttcttgaatcaggcgccttagaccgctcggccaaacaaccacttatttgttgaaagcgagcgcggtacaagtaatgttacctcatctgatatacaataaaggtggagcgccaatatatacgcatttgactgttcataattcattgaatataatttattccttgttagtacaaaagggttaaacagaaaaagacgtgacgttgtaaccgagaggatggtaacaccgcggtatcacccactcgcccagccgttaaatccaatcatccgaataaaatgtttgtccttgctagtttgtcctggtgataaaagccatgaccacttttcttggagcctgcatctgttatctctcccgtcgataatggactttgcaccggtgtattacccgcaagaattctgataacgttcaagctaaaacaaaactgctaaatgagttctgaaatggcatttatgagtacatatgatagatttgctatgtatcaaacctggaactggcgctagcgctatggtttcacttcctcattaaaccatacccttgacgatttgacaggtcgctacagattcagaaagagatcatatcaatacaacaaataaaatataagcgaataaagagcaatgtctttcccctttagtcacattactagccaacgctaattcttgatctccttcctcttgtttccggtgtatcttagttttcctggcgttgccgaagagtaaaaaaatcctaggtcctaagatttataaaatcgacaaaaagaggattcaagtaggatatctgtcagttcaaaccaatcaatcttttctctccaacaacagtttgagcttatttaatcaagaaaatgggtctatcatctatctttggcggcggtgcaccatcacaacaaaaggaagcagccactactgcaaagacaaccccaaaccctatagccaaggagctgaaaaaccaaattgctcaagaactggctgtggctaatgcgactgaattagtgaacaaaatttctgagaactgctttgaaaaatgcttaacttcgccatacgctaccagaaacgatgcgtgcattgaccagtgtttggctaaatatatgagaagttggaatgtcatatcaaaggcttacatctccagaatccagaacgcctccgcttctggcgaaatctaaacacaccatcaggatcaatttactgcgcagtatgtactcgtacttgtatataagattcaaaggataccaagaaaatgctattacgtttaataacgtcgaagaacagtattgcactatacttgcttggtatagatatgtacaaaatatatgtatatacataaaatgagttattctttttcctaattctctttttcctttagtagaatataaaattataataaggattttgtgaacatctgacagacaggctcgttcgtgtctatttccattctgaaatttgaatgcgctttggcgagacatagatttgtgtcaaaatatgaagttgagtgcctttatgaggttgggttgaacatgaacaaccagccaaaataaaaaaataataaataagacgagtgccacttatatagcttgagagagagagagagcgtttgcacgtatatgtgtgacataatcagcgtttactcatcatcgtcgtctccatcgcctgcagctattcgagccttgacatctttccataattttcctttgttgtgattctcgtaccatgaagtaatagcagtatcaaatacagtttggaaaacaaaggcacctgcaaagatagtaccaacaaaaacagcgtttcgtttgaaaaaggttttatatagtgatgaaaaagactactcataatttatgcattgttagtaacctgaatggaaacgcatggaacatattcatagagctgctgtcaccaatttcataagcttcgctaagtcgttgcgctcatcggtgggaaactaatttccaaagcccatgatacttggctaaggaagattccacggataacatttttagcctgaaatgtgaagcagcacacacacacaccaacataccattttagtccgtattgctattgttgctttacgaaattgcgaaggatatgaaaatcaaccttcaacgattattgactatccgtgacaggacattaaatacaactgctaagctaaagtttgagaggggatgtcattagggaaaggcccaaggattgagcagcttttaggtcctagaattctttcggcattgacttccccgcgtttgattgggtcgtgtataatgatacatattaacaactggggagttcaaaagttgccttcgctagataaggaaacttatgatagtcacttcgaagtatttgtaattaggttggtattacttctttgttaataataaataaaagtcaatcgacgcgcaaatgtttaataatgtataagtttttatatacaaatatgtcaactataaaacatagtagagggcttgaatctaccaaatctctcgctcatcagagtcatcattatcatcagagtcatcctcatcgaggtttcttggatttgtatttcttatgatagtagctccatcaaattgaggtcctaagaactgcaatattggtgggggattctgaggtgcatcatcatcgccatttccctgcggttgtagagtgttcctaaagttttcgaagaattggaaaaaatcacgtactccgccaccagcaataccttctgcgccaaccccaaataagttggcggcctgtccagtttcatcatcaacatccatttcgtcatttccctccgtaaaaaacccgtcttctccctcttccatatcttcatcatcttcatctgttggaggtattcttcttggccttggttctctattaaatgcaaacaagaaaccattggaaagtatagtcactcgaaattcgtcacccattactctactaatataacctggaatttcattgttaatccataatctgtttaagtgctcatatcttttcaaattcaaggtggttaaatcacctcttctcatggcatttctaccaacttcaccatgcgaatttagatatggtgcagatataaaaatattagaaggaggctgtgtcaaatggagacaaacttcacttgaattgggcatcaggaaggcgccaaatggtttaaaacaatttttattcaaatgcttggtcatttcatggcggtccgctcttaaatgcactttgacaccacatgtcaaacatattttgaaatctaatcgattatccgcattcttcatatgctgagaacgctcttcacgtagcttgatttccttagattgggtaacgtaagtattcaaatattttgataaatctatcagttttataatcccacaatattcatatgggatgttctccaaatatggatgcgatacaatggactcctgcgttgtcaaaagatcgactaaggattctttttcagtaatcattttcaatgccttattgacaaactcggcggtatcttcgaattccagttcttcttcaacctcatgaccgttgatgaccagcgtttcattttcagaatctttcactaattcgtgtagcactttgataaagactaagcaccttcttatcgtaggaagaagactcttcaacaggaaggtataagctagatcataaataatactttcggagtccaatccctccattcgtacatcagatatggtccttagggcgaagagcatctgctcacttactttaagaacatccccaattttggacgctttagcatacaatttggtaacctgttctgcatcagaaagaccctgaagaaaatctcttagaaactgtctagagaacgttgttaacgcctctgtaacagtctgacgaagtgaaactggagaaaataaagcgcttcgaacaatatattggaagagttgattttggttccaaacagtatcgggctgctgcgggtacggttcaaactccatacttggcttgcctatgacaaaggtgaacagcataatgcagactaatatattttttaaagttttgtatttctgttccctgcttctgaaaaatgaaatactgtatggcttttctaacctagaagcaatttctaacattgaaatggtatttgcccagtgcacacttaatattaaagaaacgtccttatgcgaaaagttggcccgctttcttaccgctttatcaaaaccttgacactgagatatcatcaacgaaaatatagagtttattgtacgataattttcctcagtaaaaggtttgaagagccttgacaatgtatccaaagaaagttctgattccaaaaacatatctagcgacaaaccagtatttgcctttgaggtttgacaaagaggtaaagtacaattcgaaaatgtttggcataaaggacatataaacgcgtttgatgaaaatctctttttttgaacgtacctcttgaagcagttatgatgaatgtgatgattacaggatacaaatactttcctagatccacaactaccgttttccttcaaagcctctaaaacatcatcgtcaatataagcttgtttttcatcatcgttgtagaaaccatcccacatgggcataaattcatttgggttaaaaatattaccaggtctaaatatcggggaatgatcatggtacgcaggtatcacaaaaaaatcggtcgaactggaatcttgacatagtgcgcaggtaaaatcctccgattcatatactttttcaccgaccatgtcaacatcgttatcctgctcatcaaattcagactcatgttctttcatgaatttcgtttgttgattgttaaacttggctagaagccttgcttgatgtttcttggccaatcttctttttcgttccttctctgtctcttgtaagttaactccttggcgtagtttcttatccttataatcattaacgtattggttgccaaaactggcaattaatgactcaaaaagttcatttggttttttcattatcatcttctctaacaaatagtcggctttacggacaatactctcggaaaatacgtctgatttagcattggctatgctcaagagtaaattacatataggctttgacaaataagcttctggtatagagtccttaccatttatcaattcatcatccctgaatataccatgaactaaatgtagtagctcattcaggaaagtgctatcctccatatccagacatacctggagtagtttatagaccactttggcaaataccgtattccttgtaaaagcacccagattgagagcgtctttatctaactgttttattgagacttggggtattagtacaacttttgctatttcatccttatccttagccaaatgtgatttaataatagttgcactactttcgaattcgttttccaaattcagcaactttaacggatcaacctttgcatacaagcttgcttttaatttaaaaacaccattgtcggccaagcccttaggctcaacgaaaacagagacttcttcaagtgcttcgtcaaactcggtagtatcttcagttaggtagtcaggaactgatcttagtagctttgaatacgaaaggggtttcatgtaaaggttataaatgattgaatttttgatttgatccattcttctatcctttagagaagagaaagttttaaaatattgtctttcggtcaatatttgataaataaaggcaatgaattgttgaatgatgaatgaaattttatcctcatagacagtgtgttgatagtcaacttcacctgtaaaccagtctagtaattcccatctatcaagaatattgtatattattctcggaatgtcatcacgttcccaaaggatagctaactgattcaaatgtatatctctggaataggaacctaattcgggattgtttttataatacgatgcttgatgtaacacagacataccatttcttacccaaaacccgacgtcaatttgagagcacaatacaactgatctcaaagagaaatccgatattttcagaaaatctgaacagtcttctaacgcttcgtatgcatcctttaaagacactttttcgataaggaatgaaagcattgtttgtaaaggattcataaatgcaactctttcgtggcttacgctaaacttaatgacttcatgagaatcatatattaacttgtatgttagtgatctattgcctagaaatgaactgataattcttattgcatttaaaaaaagctttgaatcaatggaatcttttgatttttcgctaactttttccgctgtttgaataatactgtaaatggaggtggtatattctaaataggagatgaaattttgatcttcgtgaagaacatgttcaccttctttacgctttatcttccacgctccattgaagagcttgcaaagagttaatagagatattatttccttaggtctcaatggaatattaggatcatgtaccttactcaataaagtttcaactgtatacaacccttgcttgaatgatatactgtaactctttgttaaattgcttttttgaactctctgccagatcaatacaccaccttccaccttacaaaactccttaaaaatgtctataattgaccacacaatatccaaaaaactttggttttcgaaaatatttttggcattcgtagggcatgtaaataactgtacgacacactctcttatagctgttagctgaggttctctatccatatatgccacagatcttgtgatgtggttgaatatttcgactacctgttgacagaaaatgggcttgtataaatttgaagaggccaacgttggaatgatcacattctgaatatcttttctcagtcttttccaatatctgttatcaaaataaagaatatgttgtaatcttgtattagaatatgttcttgatgttggagtttctacatcatttatcaatggtgaaagtgaatgggtgcttgattcgggtagaattttgtgatgacccaaaggaatttgattgccatctgcaaggatagataaatcgatgtatctgtagggatcattcttatcgaacttgttgctgaaatatttctccaccaccggtgtcatatcacgacattctgttgcatttaagtattctgaacacagggttttacccatcatgttcctaaaagtggtttggaaggaggagtttggtatgtttaaacagtgtgtaatccaaaggatgatatacttgcatgtttcttgatgaagatattctgaccacgatgttaaagtggcacttaatccattcgtttgaacagcaaaaaaaccacctaagacagatgataaatcttgtgaacatttcaacattgctcgaccttctccgtcaatcctggatgttaatagatcaatgtgtacgttatctggaaccccctgtctcaaggcagtcgtagcctgcgaatagttatgatattcatcgttatatattattaccgtgtaattttcgggatcgattttcgcaagcgatggagatgcctcagggctattagaggggctcgtctttgctgttgttgttccgtcaaacatataatcgttttcatattttaaatcgtttaaaaactgcgctctttcatacatttttccctgttgtgtcatctctcttaatttgatagtgatatctttctgtattgtgggtagaggttcgatattctggttaaaaacatcgataaaatagtcaaacacttctgcaagaaccaactccactaatgctatattcactgaatcattccatacatcttcttcctttatgtcggcatttgtggcgggatcttccgatatatcgttttcttgttcttcagctttgcaatgaagtggagaattccaagcttcttcatctccacagtcacaaattccactagtgaattcagtacatatatcggtacaaacatgatgattcacatgatcttttggattaaaacaatgaatacaaagcacacaagtatcatcgcaaccacactcatgacacctatacaagggttcccctattttgaatttcctcccacaatttcttccggtatgtttatggacgtctcctattctggattcatctatcttataaaacggaatagtttgttgagatgttatcttatcaatatccacagcatcttctaaactgtcaggaaaaacagtaagctctgggttagataatttttgttttggatgagcattgaataaagtaggtaagttctctccgctgttagaaatgacaaagtatagatatctgtaaatgaactctttaagggctctgctcatgtcagccctttcagtaggacctctcgtatacctaaaataggggaggttatgaatagacctcagtgttctcctaatgtgaccttgtaaagatcctaaatcatcatcagcaacggacatattggaatgttctatgtaatttgtgtgacctgtaaagattagggacttcagtgagagaaaatagtcaactaataggatacagtaaacttcaactgcctttgtccgaagatgcgaagaaaaaggaagaaaggtggtaaaaaaacttaataatgtatcgcaataagaaggaggggcaaagaaagcaggatgctactattaaaatagtttgcttttgttaaatgcccagtttcacgctataagtatgcaaaattaaagaataaaaagcccaatgaggaataaagcagttttattgaggtgagactaaaagggtctagcaatgaaaacaatatatgtttcctttttaaaatgtaccaaagtctttatactcgctcgttgatgtactgggcgttatcaaaactgtttgccactgggtagttgccttatggtcactatctgcaagttaaattcaatcgcaagaggaagagaaaataaaccgtcgcatcacttttctacacttacccggttattaattttataacgtttatatgatatatcttttcttatttattatattatgaatcgtgaaaacggattaagctatgcttacaatttggtttcctctagtttcgtggcaatctcgttggtcttagtagcgcctgggtacttagtacccttattctttggtttcttagcctttttcgacttttgtggtgtggcaactggataacccttttcggaggcctcttgaaattccttgttgttggcaaattcttgtctgattggctccaatagctcgttgatagcgtcagcaacaccaatttttagatcaggtggggacaatttttcttctttaaaagccaatttcatttcttcgaaggatttgtaggtaattggaccaccgaacttttctggtctatcaatgaagaattcgaagtgatttgtaccaaacttcaattcttggattggtgcaatgacatattggacaaatgacagtaaaccattctcttcgacgttaccggggctacaaaatgcactattgatctttttcttaacttgctttggttcttccaaaaggtcgatttttgaattcggatcagaggcagacattttaccaccttgagccaaacctggaaccatagggttcattaaatgtgctcttttcttgtagcccaaacttggtaaattttcttccgctaagacaaaaatttttctctggtcgacaccaccaaattggcaatcaacatctaagaattgttcgtccaacgcttgcattaaaggatagataagcccactcaataatggattggcgacttgcttgacaacatcagcgcctgcccttttagcatcgttttgtgaaacaatgttggataatctaaagatatccatggtatagtctggagttagctggtaagaagagccaacaacaaattttagcttttcaattggaacattgatgcttctcaagatagctttgatggtcaattcatagtatttggccctatagttcaccacttccaatggcgccttcatgttgtccaaaaaggcgtgcaagtctgctaaaagaacagtcacttcacaacctgctttcaagaaatcagcaagcttggtcataggaacaaaataaccacaatgaggtcttccagtgggcgcggtaccccagtataatttcaaatgtctcttttgtacttcgagaacatctttgatgatttgtgggttcaagacttcttgcaagttcttggtaatgagaccgaacgcctcattagggtcaaccgtggcagcagaggacatgttatcgtcaattagagtatgcggttatggatgctaatctctttttgacaatgactaatttgtattctgaagaaagaacaattaattttcataaaatttttctactttgtaaatgttcgagttccgttcttagtgatgctcgaataaggaccttctcgcctccatgataaaataaaaattatgatagtaagaagtatggatggttcgaaaggttgaagaatagctagggaggcctattcgagtaagcgcaaggatgtccagacgcaatccaccaggcagtagaaacgggggaggtccgacgaatgcctctcccttcattaaaagagacagaatgagaagaaatttcctgaggatgagaatgggtcaaaacggcagcaattctagttccccaggcgtaccaaatggagacaacagcaggggatctcttgtcaaaaaggatgatcctgagtatgctgaagagagagagaaaatgcttttgcaaatcggtgtcgaggccgatgctggcaggagcaatgttaaagtaaaggacgaagatcctaatgaatataatgaatttcccttaagagctattccaaaggaggatttagaaaacatgaggacacatcttttgaagtttcagagtaaaaaaaagataaaccctgtaacagacttccatcttcccgtaagactgcataggaaggatacgagaaacttgcagtttcagctaacaagagcagaaattgttcaaaggcaaaaagaaatttctgagtataaaaaaaaagcagagcaagaaagaagtactcctaactcgggtggtatgaataaatcaggaacggtctcgctcaataatactgttaaagatgggtctcagacacctactgttgattcagttactaaagacaacacggccaacggtgtgaactcctccattcctactgtaactggctcttctgtccctcctgctagtcctactactgtatccgccgttgaaagtaatggactgtcaaatggttcaactagtgcagctaacggtttggatggcaatgcatctacagcgaatctagctaacggaaggccgttagtgacaaaactagaggatgcaggcccagctgaagaccctactaaagttggaatggtcaagtacgacggaaaagaagtgactaacgaaccggaatttgaagaaggaactatggatccactagcagatgtggcaccagatggaggcggtagggccaaacgaggaaatttgagaaggaaaactcgtcaattaaaagttcttgatgagaacgccaaaaagctgagatttgaggaattttatccatgggttatggaagattttgatgggtacaatacatgggtgggttcttatgaagcaggtaactcagattcttatgtcttgttaagtgtagaagatgatggaagttttaccatgattcctgctgataaggtttataagtttaccgcaagaaataaatatgctactttgaccattgacgaagcagaaaaaagaatggacaaaaaaagtggtgaagtgccacgttggttgatgaagcatttggataatataggtacaactacaactagatatgacagaacaagaagaaagcttaaagccgtcgctgatcaacaagctatggatgaagatgatcgtgatgacaattcagaagtagagttagattatgatgaagagtttgccgatgatgaggaggcacctattatagatggtaatgaacaagaaaataaagaatcagaacaaagaatcaagaaggagatgctgcaagctaatgcgatggggcttcgtgatgaagaagctccttccgaaaacgaagaagatgagttatttggggaaaagaagattgatgaggatggtgaaagaattaagaaggcattacaaaagacagaacttgcagcactatactcatcggatgaaaatgagatcaacccatacttatctgaatccgatattgaaaacaaagagaatgaatcgcccgttaaaaaggaagaagattcggacactctatccaaatccaagagatcttctccaaagaaacagcaaaagaaagctacaaatgcgcatgtgcataaagagccaactttgagggtgaaaagtattaaaaactgtgtcattatcttgaagggggataagaaaatactgaaaagcttcccagagggagaatggaatccacagacgacaaaagctgtagatagtagtaataatgcatcgaatacagtgccttcgccaatcaaacaagaggaaggcttgaattctacagtggcagaaagggaagaaactccagcgcctacaataacagaaaaagatatcatcgaggctattggtgatggcaaagtcaatatcaaagagtttggaaagttcatcagaagaaaatatcctggcgcagagaataaaaagctaatgtttgccattgtaaaaaaattgtgtcgaaaggttggcaatgaccacatggaattaaagaaagagtaggttagtttataatgttatgtacttaataggttatttagttttcgttcttttcattctttcctttttctttccatttaatcttatgtagttacattatactgtcattttagttgcagtaagtatacttttttatctagtctttttttctgccttttttttgagaaaagactcagaattctactaaactctaatatattgttatttctgtattatacaattctatgctatgtgaactgtccttgaaagtgacctaggccacttcgacaatttcatcttcttcgtcgtcatcttcttcttcttcactctcctcctcttcttcctcttccgcattctttgatggcatctcttccactgctcccgcacctggctcgcctctcattaacatattaacaattctgtaacataattcaccaatatcttcattctcaacgtttttatgcagctccctcactagtggataaacggacttgtctcttaagtattctcttccagcatgcgttgtacatagcaaaagaatactttctaaatgacagcatataattgcaggaatcgggtctctttccttgtcctctggtaataattgaagttcatctggtaaattgaacatatcttcctcatcaatttcagaatctttagcactagcaataggtagcaggatgtaaggcaacaagtttattttttcatctttgagtaacctttcatgagtttcagaatcaaatagggaatttttaattgtggaagcgacaccttctcttcttacctttgcatcatatttttcggtaaatactagcaattttgaaataggaacaaccccatcgtattcctgctcttcaataaaatacatcctgcccaatttaaacctcgagatatccgcaaaaaaaaaggctaaataattgaaactggcatattttgttaattttttatcataacccttaacaaagcaatccattaaacaatccatggctctcaaacttttgaaaacttctttatttaaagctgctaacttcaaaccatcatcgacctcctcaccgcttgaattccttttgatattcagaacagcaagaatgccgtcatccttggctaagttgcttaataagatacacattatatcggcatttggattggttaaatcgacaattttccaaaccaaaaattttaagaacttcttgtcatcgctcaatataatatttcttactaacttgtcttcagataaattgaccaatatagtgacaccttgctgaataataacacgggtgccgtgttctggatccatgatcatttttattatatccttaatgggtctgtagctatcatttttgaaaacttttgaagtgggaccagcactaaatccaactagattatcaatggcaatctgtcttacggcaggttgtggtgaatgcagaaattccactaattcattcaattgtgaagtcatcactcaattttttgttgatttttttgagctatttttaatttttaaattaaattgataccgttttaagaagaataaacttgtcgttattagagtaggtgcgtcataaattgatggatgagatgagagagctcaatatgaaaaaatagaaaaaaaaaaaatttagaaaaagcccttcgaggaagaatagggaaaaatctacaataataattatcgtctggggtgataacagaacacatcgaaaggtagcactaccagtaacatcccaattggctctgcagctattagatgaaatatactgcgaattgcgaatcaagacatctattttttattcttgttagttttcgcggtaacaagtggagcaattgctacatactcgatgtatgaagagcttcagtaaaataatatcataacattatcgccatttttttggtacttgtttttccataagtgacagatgtcaagattaaaaaagaatatatttactcaacctgagaacctgctagttttatattaccttttatatattaatgttacaattggctctacctgaagttgtgttgtcattgctatggaatctggcaggacaccaaaaagtcacctatgcgggagatgaaggcatatttattcactaaaatctccttgacggtttccccttatattgaaaatgtgataactcctcttcaatgcttagaattacgtttcttaagtgattttctgcgtgctgttccagatggctttctatcaaattccttatttcaacaatcttttcagtcatcggcaaagcttgattggaagcttgaccgctatttaacagtaaatcaaatataacgccccatatttcttttttccaataccttttgaatgggttcttcaatttgcatcgtccattctgcagctggattgtttctatgaattttccaaaaagcatcgaatgtatgacgcctgctaatccataataatccgcttcataactccatggcttgcccgcacgcatttcccagcaatcttgctgatcagccttccaatttgatttgaatttcgttccaggtggtaacagtgtcatatcaaatgatctaccgaaatctattaaatagattcccttgttttcccagccatcctctccattgcgcatataatgagcacccaggggttcgcctggtttttctaatctgatcatgcagttatctggtttcaaatcgccatgtattattcccacttcatgtatcttttcaagtactttcattagctcgacagtgataaacatgcacaaatattcatccattattccgttgccgtcaattgccttttcccgttgtaaattaattaaatccaagaccgtaccttgactggcgtagtttaaaacaaggtagctctcatcaaggaacaagtgtaaagcactagcgttgattattgactttaatattgtgctcttcctcaacctaaactccacttggctcattatgtaatattcccatacacttgcaggtttttctactttcaacgctcgcagatgtccttgactagattctgctagatatacagtggcataacctccttcgcctaattctccgcgtatacaatataaatcacccgtcttcttgaagtcaacaattgggttcttgttttcgttgcgggataccctatggatttttttcaatagagaactcattttcaattcttggttgtagttataaaaggtgttatattggaataatgggggcgaaatttcggataaaaacttcgctcttaaattattactaagtgggttttcaataatgacaggcggttgattttttattttagtgaagggaggtatgatcgttgggtaatgctctttactcttttccgaatgttctgcagtttgtaaaagcttttctgcttgtggttcaggttgtgtgagaaatggagaactttgaatggttgtgcttgttaattgagtttgtgtttctgtattatcccccgatttcttatcttctgtccttatttgttccttaggtgtctggattataggtaccacatctgtttcagtagtttcttttataggcgtcatgtagtctgccttttctggccgtgtgctactattcgacaatctttcatatcgatcgttggtttcatttgttgaggtagtttgttgtgacaccgtctcttgtttaggatctttaacttcagttaaatcttcaatattctttgctgtaaattcttgggtaaaattttcgaagacgttgaatttacttgtagtggtatcatcaccatctaatagcgcacccggggttgaataatgttgattgaacatggaaaagacctcatttatagcgtcttttgaaaaagctgttactgtaggtgaacgggaagcgttggatgttagtgagggcttcactggtgtctcatgcgcgaggtttccatcaaccacaggcttcaaaggtaaaatagacgttgtcgtttgcacttgtacctgtgtatttttatggtgtgtgctctggctgggattatcgtcatctttaaacacctcaattcgcgtagatttggggacaacgggtggctgtgatgaaggtaagtcttgccgtctctctaccagcacatcgagcttacgtttcttcctatttttgtcacttgtataatcttcggtgtgcttcttacctctgcgctgtaccttgtaaagtcccttaatcattgccaatatttcttcggtgttgaactcctcatcattttctggatatattagattaaaattaaaaactatccgttcaggtttccgtcccggagtattgattagtttgtagactggattgttagattgcttttgatctgcatatattgaagtttttttatttccattcttcaagcgttggttagagggctgtttagagctattcaaattaagcctctctgtttctgacttaaagtcagcaaccactatagaatcttgatatacgttaggagcagacttaccaactccaacattagagttcaggttcgcacgattttccttgtcatcagtcatcaatgatgaggttaaaaatttacgaatgaaaaatggtgctgttctataaattaaccttcccttcaatctttcccttgaatcaggtacactgttctggttttctacgatgttcatttctcggagtctgtcttcataattgcttaatgaccttaatagtctgttgtaaggcctgcaattgttttcagcccctagttctaataacacctttgcttctagaaaaaattgagcattttctagtagcttggagaactcttcataaaataacgaaagctttgttccgattcccttgttaaacatatatttaaaagtattttcactctcgtggaagttgttgctaagaaacaaatttatataccaaatccaaatttttaaaaatctgggatcgttcctataggtttccatatcttgtatgtaaatcaagcatctttccattgtacttcggagaacttcttgacctgattcagaatctacttcaatatagctggtgctaatccatatcatataatctaaaaacaaatctaaaggatcatccatatcctctaaatcatttagaagtctctgttcataagctatttttgtctgattcagttgactatgctgctctttttgagatgagctaacgcctttcgattgcggaaatgtgtctttatctgattcatagcctcgtacagtagaacctaaatctaaattcatttcctggtcagcgttaacattcaaacaataggaaccgtcaataatctttccatgatgaaaactttatactctattctaaaatcacgtatattgtgtatgtatatgaacaacgcttttttttctttatttacttcctagcgcgtatcgaaagcgaaaacaatgaaagaccaaaaaaaccgtgtccgttacaagatgaccccatggacgtgaagtcaaacgttaaacacactcctaaaataaaaaccagctattgagcattaattagtagagaattcattaagacattaccttgaactattttaaaagttggcacaagttatggagtcggtagaataaaactcaactgtcatcagattcaatggaaactgaaccatgagaattggggggataaaaggattaatgagaggtgacgtataaaatcaagataagaaaccattacataaaacgttcaattgcctttctacttgcatgttttcaatacctcaaaaggagaatgttttgatatatgttatatatcattattgtcttcgctaagaacgaaatctaacaattctattttgtaatttacctattcagcatataattgttacagaattggatttttatgttccttgagatagctttcgatattttcttcgtacagcgtcgatgtctctagtttttatccaaccgcactttatattttaacgtttgatggttttctatcttggcagcgttagaacttgatgacaatttatggaacttagtttcctattagaaagggtaactgtggcataaatgtaatagaagttttcttcgagaattataaactgttagaataaggactacaactatcatctattgttggaatgaaactctaaattatcttttatttagtagtattcgttttactaatatattatcatatacggtgttagatgatggcataagttatgagaagcggtcattgaagttagaggaagctgaaatgcgaggattgataatgtaataatgaaacatataaaacggaatgaggaataatcgtaatattagtatgtagaaatatagattccattttgaggattcctagatcctcgaggagaacttctagtatattctgtatacctaatattatagcctttatcaaacaatggaatcccaacaattatctcgaaattcacccatctctcagaattattcacccaaatctcagaagactaaaaaagaaagaaatgtggataatcgagtctatagattcttaattacatattaaacctgagaggtcagatttccaataatagaatagccttgttggcgcaatcggtagcgcgtatgactcttaatcataaggttaggggttcgagccccctacagggctttctttttttctttaaaacacgatgacataaatttcctttgtatgaaccgtacccttaataataaaaggaaaaatcatgctttaggtataagactttctgttgtattaaaatttagtatttatttttattatgctattatttttttcggtctcaaatgttacttagtgatctacgaatattgttctaaaagaaattttccacttatagcaaggctagtaaagctacgagtacggaaaaaagttttccctctcttggtaaactctgagctaaatcagcaccgttagaaatttgaacagagtttgtcgagctggcttcggaggaagaactttggattgtagatgtgtatttgcttgatatctgggtagtagaactggtcacgtcattacttgatgttgcgacaccacccttatcttgtacaggactgtccgatgatacggaagattgttgagtagttggggcaactgtagacctagtggtagaggaaacagtggctggggtcttagtggaggaaataatggactcacttgtagaagaggaagccactgttttcttggatgaagaggaggattgcttttcgaatgaactaatggaactagatgtggtgactgatgaggaagcaagtgttttagatgaagtagcggtcgaagaagatggagatgtggatgaagaggaagatacagaagacgaagaagatacagtggaagaaaccgaggaagacacagtggaagaagccgaggaggacacagtggaagaaaccgaggaagatacagtggaagacgccgaggaagatacagtagaagaggatgtagagctgctggaaatactaccaccgttggctaaaactgcgaaatcttcttgggcttggtcatacctgccgtaaatagaaccaccgtcagcttcaatagattcccaagaaccagattggtcaccatatgtgtactttttaccggtagaataatcagttacaatgaccttttcaatgtacatagtgaatggagcgtcattgtagttggtttcaccaccagcccattcaatggtaccagcagcattgtctgggtcaccaccggcccagatacccatcattaggtacataggagattgtgggtaaccctcacttgatgtgtttgataatactctgacagactctccatcgaggtaccaagtcgtcttgtccatcgcccaatctaaagtgtagttatgaaatttgtcggtaggagtgtcgacaccgtgaaattcgcctctgtcgtatgttgtggtatcacctttagaaaagaagttagattggaactgagtgttgtcaccacccacccattcaatatcaatttcatccaaatcatcactttgtaaatagaatgatgaaacaataccggtaccattggcagcttttaagataacttccaatttaccatacatgatataaaagttagacttcaaacttggattatcgtatcttttcgccagtgtcattgacaaaccgtctgaaccgtacttgatttcacctgcgtgcttcaagtcggtaaaccatttggatgaagatgagaaatcttcgctaaaactagttgccaaagctgtatccggcgtacaacctgtagtttttaacgggttacacgaagcagtgctagaagctgcagttgtactgtctgcagtagcagtactttcggcagccgcgaatgtagataataatgaagaggcactgagtaccgttagtaggtcaagcactttcatggttttttgctgtattgaattattatgaatattatattatcttaacctttctcttgctatttagtagaaatgtagaatatggagaggagtaggcaattattgaaagttccaaaagtgtttcaccttttgttctttttcatgttactaaccagcaagtatttatataacatccattgttgcatgagggaaaccagtaaccatacgctctaattatatcacattcccgattcggaaacattgcttcttgatcgagcgaaaagaaactgcccttgcaattaataatgtcattttcgtatcccataccacgaaaagcaagccctcagaggttctaatgcattatagctcagatctatttttactttcctggaaaacgccatcgaaatagtcgccaaaaaaatcgatgggctgggaaaacgcgtcatcaattcaaccgaataaggaaaactaagccacttcacgcggttcgcgatatttgtccagcctctttttccgaaaaaaaaaaaattaaataataaaatgaaacggacaggaattgaacctgcaacccttcgattgcaatcttattccgtggaatttccaagatttaattggagtcgaaagctctaccattgagccaccgcttcatcttgaaatatcgaagatataacattttacttgtctgccgaaattctgtgtttgctataatgtttgaattagaatctcttaaaatagctactcatacttcttcataactaatccattagtgaccatatgaagtaatcggacgccacacatcattgatgtttcacgatggagaatgataacacactaagtggcattgtgggcaaagtaagttaaacacctattgctcaaatgatcaacttggtgtttgcacatatacggatgtaagtcatgacattgaaatcataatatgctttcatgataatcatatgagcatgtttaatattactaataaggctgtattctatacttctcttatatagaataagaagatctgcatttattcttgattgacactacagttcaacaattaattaccaacagaattaattactacctatcgttcacaagctactacgttatcatacacaatgtaaaaatatgacacaaaaatggaaaaccgtcatcagatttaatggggctgaaacacaagaattcataatgtgatagaataatgggtgaagtgtataaagaagaatatataatattactgtgtagaaatatcaatttccctttgtgagttctcataacctcgaggagaagtttttttacccctctccacagatcgatacttatcattaagaaaatgggacaccaaggttacggaaaaatctacccggtctacctaattactctcttggcgcactagttttccgaaaaaaacaggtaaattcttctttagataaagataaatataaaacttcacagccattcactcacacaaactagtcccttagggtgcgtataatgatctgtacatcttatttctatatatcttaccgtgtattttttcttttctcaattcttgttcgcaaataaaaagatattcgtgtttgtggaagaacactagttccgttttgtattcaacctggaaatttacaatagatcttcatcatcgtatgtctaccatgttaatctcccgttaaactgtttcacgttatcaagattatgtcatctattcctgggcgaacataattccttacaaaaacatttgtcattacacaagtgtaaggggtaatgaaaagtaattttgttacaagtacgcaaaattcgtttatttcaagaaacactaaggatcgtcatttccctttctgaccgatgttccttctttttgctatttttttcccgagtcatctcatcgttttgagtttttcctagtccattaaattgtcaccttactctcggaaaaaagaaacgacaaatgctcctagtgccgtttttcgaagcttgaaaaaaaaaattgcaaattatttaattttgctgctaaggagttgaagtaggtgcattccgccttattgatcaccctgttagatttgttgcgatcgttatagtgctagtttgtccattgttgtgtcataaaagatagctttgggagaaaattcatcaaaacaacatatcatcagcgttattacaattcattgtccttcccaagtttttttgacgtataatattatcgctatctgactcattagtacacaaatacagatatacaacctcaaaatcaaaaatgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacttaagccttggcaacgtgttcaaccaagtcgacaactctggtagagtaaccgtattcgttgtcgtaccaggagaccaacttgacgaactttggagacaattggataccagcggaagcatcgaagatggaagagtgagagtcacccaagaagtcagaggagacaacagcgtcttcggtgtaacccaaaacacccttcaacttaccttcagcggcagccttaacaaccttcttgatttcatcgtaggtggtttccttgttcaacttgacagtcaagtcaacaacggagacatcgacggttgggactctgaaagccataccggtcaacttaccttgcaattctggcaagaccttaccgacagccttagcagcaccggtggaggatgggatgatgttaccggaagcggttctaccacctctccagtccttgtgggatggaccgtcaacagtcttttgagtagcagtcaaagagtggacagtggtcatcaaaccttcttcaataccgaaagcatcgttgataaccttggccaatggagccaaacagttggtggtacaagaagcgttggaaacaatcttcaagtcagaagtgtatttttcttcgttaacacccatgacgaacattggggcggtggaagatggagcagtgataacaaccttcttggcaccagcgtcaatgtgcttttgagcagtgtctaattccttgaaaacaccagtggagtcaatggcgatgtcaacgttggaagaaccccatggcaagttagctgggtctctttcttggtaagtagcaatcttcttaccatcgacaatgatgtgcttgtcatcgtgggaaacttcaccagcgtatctaccgtgagtggagtcgtacttgaacatgtaagcagcgtagtcgttggtgatgaatgggtcgttcaaagcaacaacttcgacgtttggtctagacaaagcaattctcatgaccaatctaccgattctaccgaaaccgttaatagcaactctaaccattttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggtcaaagtatttcgaatttgtgtccattagtggtgttccgtgtgagaactggtaagcttctttcatgaaagagttcaatgattcactcagtttgtcaaacggaatagaggcgggagcatggaacactaattgctcttcaaattctacaggagtaatctttggcttgtcggcagcttttgtttgagcttgctcggctatttttggtttgagctgtataggtttaatgttcgataaatcgagacgttcgttcttcttgataaattctgttaccttgttaaccgaatcttgtggtattttccctaggtatgctagcacatcaccctttaatagtctaccgttggaaccagatggcgcaatttccttcaaagccttttgtttggatatattgttctcagccagtagtaatgacacggatggtaatagcgtctgttcaagattggcttggctgccgtcaacggtttttattggtgtaactgtggctttttttaaatgttgttgtgttgcttcagtactatctgcggatggcttcttaatttcaatagatttcgcatttgcggtgttggcctcttggggtaactttatagtagctaaatcatcatcaacatcagcaatataagcaataggttcaccaacatcaacatctttagagccttcatctttcaggatcttagctagtttaccatcgtccagtgcttccacatcaatttgagatttatctgtttccacttctaatatcacatcgcccgcgctgaatggttcgccaactttatatttccaagacacaatcccccctttctccatagtaggagacattgcaggcattgaaaatgtctttacagcaagtaatttagctgatgcatgatagttgcatttggttaaatatcttgtacatgattttaaagtggagactttggaaattgcacttagcatttttgaatttttccctcgagatgatttaacaataacctagctctttcaatgctctcttatattctcactggaaagcgctaatttgatttgtctctctcgttgctggtcgctcaccctttcataaattgttttttactcttcatttattgattttactttttgtcattttccgaacggggaacaaaatgatgactacttgctacagtatacgaaacatacaagggcattgtcatgtgcacgcataataacggtgatatatatatatgtatgtatattatgtgtctgtgtttgtgtgtacttgtcagggcatgataaattattcaaacatattttagatgagagtcttttccagttcgcttaaggggacaatcttggaattatagcgatcccaattttcattatccacatcggatatgctttccattacatgccatggaaaattgtcattcagaaatttatcaaaaggaactgcaattttattagagtcatataacaatgaccacatggccttataacaaccaccaagggcacatgagtttggtgtttctagcctaaaattaccctttgtagcaccaatgacttgagcaaacttcttcacaatagcatcgtttttagaagccccacctacaaaaaaagtcctttctggccttttatttaggtagtcccgcagcggagattcatcgtaatcaaacttcacgattgtatcttcgttcagtctctgttgtgagcttgcgtttgaatccgaaagcaggggagatattcttaccctgcaacttaaagcctgtgattctacaatatttttggcatcgtgcctcttgtctttgaacttggccacctctctttcaatcatacccgtttttggattgaagataacccttttgtttatggcttttacgctaggaacgatctcccccagaggaaaatatacacctaattcattttcactactttctgagtcatctagcacagcttgattaaaaagagtccaatcgttagtcttctcataattattttcccgttctttgtttaactcgtctcttatcctctcccttgccaaagaaccattacaataacaaatcatacccatataatggtttggcagagttggatgaatgaaaagatgatagttcggagaggggtgatacttatcggtgaccagaagaactgtagtacttgttcctagggaaacgagaacgtcattcttccgcaggggtaaagaacatatagtggctaaattatccccagtcatgggagagaccttgcagtttgtattgaaaccgtacttctcaataaaatatttacagatggtacccgctatcaaatttttcatgggtgctctcattaatttttgtctgatagttttatccttagaagaactatcaattagatgtagtagctcatcactgaattttctttcacgtatatcataaaggttcataccacaggcatctgcctcctctaattcaacaagatggcccactaagatagaagtcaaaaaattagacactaaagaaatggtctttgttttttcgtaagcttctggttctaattgtgcaattttcagaatttgaggaccagtaaatctaaaatgggctctggaccctgttaattgagccattttttcaggcccacctatgcactcttcaaactcttgacattgctttgcagtactgtggtcttgccaattgggggcggtttgccttgcaaatgctacagagctcacgtagtgcaataaatctttttccggtttcttattcaattgctctaacagagattcggcttgggaggaccagtagacagacccgtgctgctggcaggaccctgagacggccataactttgttcaatggaaatttagcctcgcgatatttcgagagaaccagatctagagcctctaaccacatggctacgggacattcgatagtgtcgccgtgtatatagacacccttctttgtgtgataatgcggaagatccttttcaaattccactgtttctgaatggacaatttttaggtcctggttaatggcgagacatttcagttgttgggtcgaaagatcaaacccaagatagtatgagtctaaagacattgtgttggaaacctctcttgtctgtctctgaattactgaacacaacattaaagtactaatctcatcctccttttgtttttctcgagagggcccccttattcgtccgcctgagattgcattggccgaattgaaaagtgacagttatgcacctcagcggctattccctgcgtcgcttgctgaagattgaggattataggaagtagtaagctggaaatggtaatttgtaaaaagaaaatttctaatactgtgacaatgttattaaatcggggttgtttttgtttggggcggccagcggaataatttgttttcaaggacagcagaagctcagaagaacaaaatctccgtgatcttttaaacttttttccattctgatggaataatggtcttgatcccctaaatatttccttttttattgcaattatgatagaaattaatagtagtctatgctggatgatatatatatctcttttgagcttgcttcaaattttttcccgttataatgatgagtgttttgcttattaagggtctaggacatttctatcagtttctataccaaaagaagaaaaagtggagaattgtttgtttattttaatattttgttctttagttttaaaaattcagaagagaaaaaaattttatttgtcacaaggaaataaaacataaacaaaaaagaaaaattaagatttgcaattctgccgcttaagcaaaagtagatcattcactggaatatatatatataaacgcatttataatcttgtaacgtgcactcaatttagctacgaaagccaaccagcaaggaaccttttatttgagtaggtacatttacatcttcgggtaacgcggtgaaattgaaaaattttaaggcattaataattgaaaagctagaagaaatggatgaatgaatgacattgcgaaccattgtgcaatgaacatcatccaaaagaaaacatcatttacacatattttctttccagggtcccactggtaaaatctattaacatataaaaagatttacaaaaaaactttagtgccataactacagcaggatcatcatatgtcaagactagaaatatactcgccagaagggctacgtctcgatggacgtcgatggaatgaactccgccgttttgaaagttccatcaacacacatccgcacgctgcagacggttcatcctacatggaacaaggtaacaacaaaattatcactcttgttaaaggtccaaaagagccaagattgaaatctcaaatggatacctcaaaggctttattgaacgtatcggtaaacattacaaaattctccaaattcgaaagaagtaaatcaagccacaagaatgaaaggcgtgttcttgagatacaaacctccctggtgaggatgtttgagaagaatgtcatgctgaatatctaccccagaacagttatcgatatcgagatccatgtccttgagcaagatggcggtattatgggatctttaatcaacggtattaccctcgctttaatagatgccggtatatcaatgttcgattacataagtggtatatccgtcgggctgtacgatactaccccattattagataccaattcattagaagaaaatgctatgagtacagtgacactaggtgtggtagggaagtcagaaaaactttctcttttattggtggaagacaaaattccgttagataggttagagaacgttcttgccatcggcatcgcaggtgctcatagggtaagagatttgatggatgaagaactgaggaaacatgctcagaaaagagtcagtaacgcctctgctaggtagaataaaaaacgccattaattgccactgtttatataaaagtacataaaaaacagtaaaattgaaaattgaacgcatttacattttcgtgtttctaccgtaaagcaaaacgcttacagttttttcttacctattgatgcgaataaatcctttggtttcatagaatgctggaaaacttttctccttaagtgcgttacattttggttgacactagcaaccgtgttaatgacagtatgcttcttactcaaatcgtccgcgttcgcatatgcttccctaacgtgactatgctgcttatactcctcagctatgaaatccttatccttattagaggatgattttagcgtataatttatccatgtttgtatccccgtatcatattcatctagctcacgcttataatttctcaactgttctatcttaccggcgtgcgaagtcttactgttcagtagtttattcatatctaatttcggtaagttattctgctgccccaatttcgccatttcttcagtactgggttcatggacgcttgtcatttcgccttgagatactgttctgttttcacttttgaaagatgcactgcgcgctgccaaatcattggcagtattgttactattatcattatctgttgtactattatcgtttcctgcatttaattgttcctgtgcgtccatcggtagaggtggcaaattcgattggttaccaatcaaaccgggaacattataaatcgtattgttgtcgtatatagtcttagtgtccctgattgtctccaaatcgtcatcttcgcctttggaagggaatgcatcccaagtactctccatctctgaataagtcgatacaacacgtggtttcatactagcaggtgttaaatctactagcttcccgttagaatcgatcacgtaacctggtggcgctttcttattggctgtatcctgtacgaaccctgatcgtaaggcctcactgtccggcttccaagaatcaacatcagtggagtctttaactgaactttcttccaaaactttgtcttcatttatgtggtcttcctcatcgctgccatcgctgttttccaattcagaaccgctatttgacaaattggtattttcaatggtgtctatttgattaggttgcaatgctgaatcacctttatcatcattaccaatcattttggagaaataacctgatttgggcgccttgagactgccttcatctgaatcagagctcatacctttttcctcctcctcttcatcactcgtaagtagaatggaacctttttccctattagaaaatttatagctatctgtatcttcattttcgtcttctatggattcattatcttcgtttttgtcttctatggattcattatcttcattatcttcttcttctgtctcatttgtcgaatattttattgattcggtatacgacaatgcatcatcgtcagttgtatcaagttgtttcgattgccggttaatatcagcatgtttatcactaaccgaagatcgattatcatcatcactactaccactgttgccttcgttgttatcatcttcttcagagtctgacgaatgctgataatcattgaaaaaagaatttcgatatccattatcactagtttttgtttcatttgctacgggtttcggctttgctactttatcttgcccactagatgtagagttcctattcctaatactagtcttttcttcacttttttctttcttttccaaagctcctgagctctcgacttcaccatcatcttcttgttgtaaattctcctctttctccgcaggcagaatatctgcaaggtagcctctttcggaaactttaaactcgtcgtctttctgctcagaaacatcgccatcactactcaaatgttcatttccattccttgttggcgtattgaaagtggtatcagcttcattagtatccattgaaacccctaaggaatgtgatttttcatcttcttctacaggagatgatgaagagggtaccgcttcccctaatggtgcttcgttttggatttcgtcacaactgtctgaatcacgccgaaaatcagatgtttgcctaatttctggtgtcatctcccttgatatttgctctatcaaattgtctaggtcttcgtttacagccctatttgtatgtggtgattttttgttttcacttggacttttcaaagatgctgtcgacgaaagataatctgatttggagtgctcgctggattttttcgcttgtaattccacagactctcttgaagccataagtttaggcaccccatctgagagatagcctacttccttgtcactaggactaatatcactcttactgacgttattatcattgctgtctttattttcacccgtattttcatcatgctcaccattaacatctgtataattgagcttgggtaaactaggcaaattagatattttttgcttgtgaatttctgaaccttttgtgccatcctcggaagagtagtcatattcgtcactactgtcccatccagcgccgtcataacttgcttgagatgcgctaacccatctatacgatttctttctaccgacctgttcagtgctcataataaatatccgctttccagaaaaagggtaatgatcaaacagtcccttttaactataatgcaagttttgtgtttaccttgttaaccatgtatgaaagtggtatttaggaatacttttaagtgccttacagaattcttggcatgagaaaaacaaaatagctacccggaatgaaacactaatgtgtcaccaaacaaacaaacgacgttatataattgttgtgatatttgcatcttcatcttatgatgatgagaatataaataatttttaatcgtattaagtgtatatatgaataagctattaaccctacccattaatttccgggcgggttgttatttttatcagtattggcctctgccgggcggctagcacgctgggtagctgctgcgacagcggcttctgctgcttgcatagcatttttttgcatttttttacctgcaaacttcatacaaaatggcatcaaggatgtattgagggcaacccatgccacgagaataccgtaatttcttcccatttttcttttggttaaattcaaaaaaatcactttatagatatccacggcattatggattggcattatgtagccgtacctgtaaaattcgttgttcaaaaccattgggtagaatgaagcagaaatatttaatatgatccacgtcatcaaccaaatactcaggtatggagggcagtaagctataactaagctgagaacgttttcattggcaccaccaacagccatcattaccaaccacgtagacatccaatatactacgaatcctcctctgccaaaggcgggggtgaaatcgatcctaaaaattgcagatacggtacagaatccaatggaaagaagaaaataagttgcccaggaaattagaagcctgtagattaaaatatgctttggcttcagaactctggccatttctccgtgcaacttaccatataatgacagttgtaaaacggttaacaaaatacaataaatcagaccgacctgcagaggggccattagaatacgatcagcaaagggacgataatcgttgtaggtgaacaacaactgtcctgcaatcgcccagttctccatgtttatattaagatctctgtcattagaagtgatgttgctcatcaatgagggaagatattccttgacgtaatatttctgaaggcggacctccaattgttgcatgagtggtagaatggtcgatttaacactcgatgggtcacgaccactttcaaacacggattcaaaaaaaattgatgaattgaactccgagtttgcgtcttggctaatcaaagaattatacaaagtgtctgtagcattaggtttaacgtttaacgccagccagtatctctcatcgtaaattaaatcgactatctttctgtcaatttcggtggagttcgtcgtaccaaatttcctatgaaatgatgttgcgttgtatatatgccatgtcccggggacagacgctaacaatgagggtatgatcgcggaaatagattgaactgaagtattagatggcgcatcctgcaatacaacaatatttttcactttgaaaaagtaacgatctgttccgtaacaggcaccccagtaaatcgatatgagcgatacacacacacaagcaatgaagaagttgttcaaaacaaacttcgagagaatctttttcctatgatttcgcagtcttggagaaaaaagccctgtttgaattcttgccaagggaccgccgtcgttaccgcccttctcttcctcattagcgccaccttcccccacagatgacaatgaggacggcttttcatcaggaggccgatagtcttctaatgactttgctaagtcagaagaatggccggaaccctcagcaaatcgctgattactgtacgaaaccccgtccctgccgccagtaaatgcagctgctgctgcaaaactagggtcctcaatgtactgtgactcttcatcaccaaccgatttagtcatatttgttctctgtacggctacttacacttatgtcagtacccgattcttacggcgtataaaagattaaagaaacaggatatgtggcttgatatatacaaaaaaaaagaacgatatggagtacactatgtatctctcaacaatgctaagatatgaagacgcttattgactacgccagtccgttttccattcccttcttcgaatagggtggcccgttgatgacaaagctgcgagtcatctatcatcaaacaaactcacggctttcgcttttctttagtctatttcggattgtaccacctcctcggacattcataaaaggattcgaaaacgaataaccacgcatatacacggaaataggagaaaactaaacgggaatcggtttatttttttctcaacatttctttttcctgattttccatccttttcgagatccacctattgtggtgaaaaataacgaaaatatgtgctttaggtgtgcaaggcataatgtgtggcatactggaaggaacaagttgaacacgccagctggaaagaagttcaataccaacttgcccaatgcctaactcaaatgttcggattcctcctactgttccatcgaagataatagatgtggtcgaccaagcgctaagagcgcgactcttaggtggcagcaccttcaattcagggtttgatagtttagattccgtacttaacttacagtttagactacattaccatgttattggatcgaatgggcctgcaaaaccagtttgtgatgttttactgaaggaaagtcaaaatttagaaaagaatatgagtatgatggaggagttgaatgactatccggagattacaaaactagtggagaaaattctgttcaattgcctcggtattcttttcttccacaggggccaatttcaggaatcgcagcggtgcttgctgcactcgttgaaaattcataataacactgcatcgcaaaaaacagcacttatggagcagtatgataggtatttgatcgtagaaaacctgtactaccgtggtctagtttcgcaagacataaatatcatgcaaaatgttttttacaaagaactactggcccacgtggatacgatccctcccgaatcaaacggtcttcttttcgaatacatcagcttgatcgtcgcaaaactcaggttcaatcaaattcaggatttagcagaaaattttaaaactaccgtcgaaaatccttttattcttttcctttacatgataaagaagttccagtcacctctcaaaaagcacattgataatgatgatctttatttgaagttcggacagaacgttttgttgaaggccaaatttcctactgctagtgagacaaatgatgaagctttggagcattttaatgtctttttgcagtattatttcaaattcactcacataaaaaaaataaaagtgaatcccagttggtataatttcataatatcttcaatggaaaagacttttcaaagtattgaagtttcgaaaacagcaatgtttcttttccaaaacctaagcgataacagtaatgacgaaataaagaagaagacatttaaaagagaatctatactaaattttgttaattttgtgaaatacaacgacaagtactatcaactgcacgataactcccaccgtgacataatttcattcattgatgcgtattcttttattttacaaaactcctccaaaaccgattcaatcgaaaatgtttttgattacgataatacggtatctacgtttgcgacttccttgaattccttctacaaagaatataatttgccattaatgagccaatcagaatctttagattggctagaaaacagcaccagatgtgtatacccaggaaacatttcgaaagttctaacaaatgcgtggtcaacattgtacgaaatcagaaaatatcagttagattttcttgtatctaataatttgacttcatatctatgtaatgcaatgatgctgtccacaaaagaaaaagacaatgctgatgtagaagagcaggaagaaggagaggaggagaaggcattacgtgaattacaatttaaatattcttacactctagcacaacagaggcacattgaaactgcaatcaagactctagaatcattgatattaagtaaaaacccaaattactacaaagcttggcatctattagctctttgtaggtctgtgcaagaggataaggaaatgtcgtacaagatagtttgctctgttctagaagctatgaatgaaagtcttcagaacaatactttacttctgaatgatagatggcaatttattcacctaaaattaacgcaattggcgctaattgaagaaatttttggcactttagaggcactggagacacttccagaggtctttgaattatacgcaacattatttccagattcacaacctgaattgaacagcatgggtcccaaatattctcaaactaaagaatatcttttacaaatggtgtggatttttgctgcaaatatgtacatgagaacaaaagacaatgatgaggatgccaaggccgccatcaaagaagcctccaatgtcgaaagtaaattcaagaatttaaattgtaatattgctaacggttatttatcaataataaaagatgaaccaggcgtggcattaaaggaatttgaaacagttctgtactatgatgagaataatttagatgccttggtcggattcgctgaattaattttccctgaagaactaggcgtcgaggaaactaatcttgagcgttattatactctcagccttgataaaaaaccaggtaagagggccaaacttacgttcgttaatgacacagataggtcagcagcgtatgcaagactaaaatttctattggagtgcgcaatactagaatcgatcgaggcttactattccccagaagtttggtggtatttgtccctcatttacgagaaatatcaagatgacgagtacaaaaactctttgctaaaatgtattaaataccaagagttgaatcccattcgctccctaaggtattgcaattactaacgataattcttctgatatatacacacacatatatacatatgggcgcaagtatattctggtgtaaagatactcatagaaagcataaagatgtaattcaatctagttgtattatattattcattgatttatattaatttgatgaacaatggaacatcttctcttcaataacggttttgcccatatacttgacgttattaggttacccgtttttataaatgtaataagttcaataatttgaaaagagcattagctatagtcacgtttcgcgttgaaacaattctttaaattatcttctcttggcagtttaatataccaaacgatagtcctaacatactgtttttcttattatttaccaatgagtaaagccaagggaacgggattttcatcaattgatactgaagatgaaaacttacgcgaacgttatgttaatcaaccaaaagctaatgcctccgatattcaagatgaacaattagattgctttgagcaactagaagaaaaacataggacaaaaaaaaatgaagaatacactgcgttgaaaattttaagggatgtcataggtccccttttattaactataacttcgttttatctaagattccaacatatagatcagaacaattatgttgtctgggatgaggctcattttgggaaattcggatcatactacatcaaacatgagtactaccacgatgtccaccctccacttggtaaaatgcttattgcattgagcgaatggatggcaggatttgacggtcaatttgacttttcctctaataatgcatatccggaaaacgtaaactttaaactaatgagacaatttaatgccacatttggagctctatgtacaccagtagctttctttacagccaaatggatggggttcaattattttactgtttatttgattgctacgatggtaacgttggaacattcatatattgtcctctcaaaattcatattgctagattcaatgctgctttttttctcgatgacgacttttgcctgtatgataaagttgtatacgttgagaaagcaacaaatgacgaaaaaatggtcgttatggatgttattaactggtttatctattggttgcgtttgttctgtgaaatgggttggtctttttatcacagttgtagtcggcctctacacatgtatagaactatttttgctctattgtgataaagaattgcctagaataaaatattacaaacattggcttatcagaatcattaatctgatagtaattccttttcttatctatctctattgcttcaaaattcactttgtgttgttgtacaaatctggcacgggggattctactacaaatacgttatttcagataaacttggagggaactcagattgaggcgggtcctcgtgatgtagcatttgggtcagagttaaccataaggtcgcatggtttaagcccgaatctgctgcattcacatattcaagtatacccagaaggctctggacagcgccaaatcactggatatggattcgcagactctaataatgtttggaagtttgaattttctaggtcttctggattggaactagatcagaacgggactttgaatggcaaaataatcccaataacggatggtgtggaagttcgtctcagccataaaaatacaggatcgaatcttcactcgcatgatgtaccttctcacgtctctagaggaaattatgaggtttcaggctatgggtcacaaagtgttggcgatgaaaaggatgattggatagtggagattgtgaaacaaatggattcaccaaatcccgtctattctaatgagaattcaactattttacatccagtttctactttcttcaggttgagacacaaagttttaggttgttacttggcttctactggattgacgtatccagcttggggatttaaacaagctgaaatcgtctgcaaagactcctggagtcgtagggacaaatcgacctggtggaatgtagaagatcactggaaccacaatttagaaaccgcagaagattacgttccaccaaaatccaatttttggaccgattttattctaactaattttgccatggcctcctctaataacgcgttagtgcctgatgaggataaatatgatagtttatcgtctgatgcatgggaatggccaaccttgcataaagggctaagaatgtgttcatgggcgggatatatcactcgatattacttgatgggatctcccttcaatacatggatttctactgtctccttaatcatcttcccatttattattctttttatattatatcgttggaggagacaaacgctttatctctcagacgatcaaatctggcaaataacgatacagggtatttttcctttcatttcctggatgacacattatctgccttttgcaatgatggggagagtgacgtatgtacatcactacgttcccgctttatattttgcaatgcttgttttcggatttgtgcttgatttcactttgacaagagtccattggatggtcaaatatcccatctatttgtcattgtttggcggatgtatatacatttataatttatttgctccaatatgtcagggtatgcatggtgataaagcggaatacttacctttgcagtggttatctacttgggatatcgcaccttagtaaaaaaaaaaaaaactccaactcctttacacagaatcacgaaaattgtaaataataatgccaaataaaggcattaacttattatcctcttcttttcacatgagaaatgatatagatattgcctattcatatgctaatgagtatatacgggtggacaaatcactacttcctacacctaaaaataatttaccgtttctctttaaatgtgaccacctcaatcttgtaattttgtctgctggtgttatatcctcgtttagctgcgttattaactcaaactttcccaaagtataactgtataaataaatctcaccgttttcaagacccaccgatatcaaaattttctctcttatcatgctgtcatgtatggaaatagcagtgacagctttagtgtgtttaattgatgcttccagaacgtagtcatcagctggctccttttggtgcctccatactttgacagttttatccctggacgcggtgacaaaaacattaccaaactctaatggtgcccagtctgcatcccatataatccttgtgtgtggtttttcatttttgaatctcaattcaaaagtattatcttccatatttctttcccaaagcgcccattttctgtctctacaaacactcaataaaaattttccatctttagagaattttaatcttgttatcgttagactgtggaacggtaatgcaggctttatttctaaccaattttctgtgctgaatattctaataactgcattctgaacattatttgatctacaagcagaagcaattaatttctgatccggagaaatatcaagacacgttatttcaaaaccatgtccgtaaagcttttccacttcaggccataacaagtgtctttgcaattggtcttccataggtggacattctagcaaggacaatggatcagtgatatctggtgtttctttattaccaccttcctcctcttcatcatcttcatttgcgtcatcctcaccagctttattagacaaacctaacacaggaacggtagcagagtctggcatttcacttttttcctcaaattgaataccaacaaacttttgtaacattcctgccacccctttaggtaggtcaaatgatctcaagattttttcatcaccaccacttacaaatctggtatccgtcactgtctcaacacaaatcatatcataaccatgtatttgtggcctagaaaattcatgccaggtagctatttccctttttctcccgctggcatcataaatccatggagcaaagagtctagtggtctgatccagagaagtagccaataggtactcgccgctaggagaccaagcaatgtccgtcacatccttcgtggcaccggatatgcccaacctttgatcgcaaataatattatcctttgtagcccacatcctccaggacccagtcttaccattggtcaaaaagaaatccattctctcatgagtaaaccatagacaggaccaaaaacctccagaggaacccgttgcagttgaggcaccttttgaggacatttctcctaaccgtagactgcacacccaaatgcctgaagtctcatcaggttcccataccatcaatgaagtatcagcagtagcagctagtagttgtaagcgactttcgtgccactgaagggatgaaatccaatcatcatggcccataattaaggcttcaaaatttatgcctactctcaattcatcatcaatttgaaatttatattgtttattgctcaataatgttaatttctttgaatcttcttcagagtcatcgattaaatcgttaatcctaattctccacaatctaatataacggtcctgagagccagagcataacaaataatcacccggagtttcctggtgacggaaagccaatgacttgacccagtcttcatgaccttccaattctgcaaccactcgacacttctcaatgccagaatcacttaaaatgaaagatgcgataaaaacgttcacattagtacccccaatggcaagtaaatactttttttcttcaacttttgacagtgataaacacagtggatagaagaatcccttttttatggtgaattcatgagcaagaccaaactcatcattttgaatattttgtctccatatgctgatagtaccatcagcacaaccgactgaaataagacttggtaaagcgcttaatgccacaatcgtcttcgagtaatgttgaatggtttgaatacattgtaaatgtgagtaatcagtaaatttccagatcttaacatgatgatcctcagatgcagataccataaaatctgaatctgggacaaatctgacacaagtcacttcagcttcgtggcctttcaaagttgcataaacacctttattatttggttcaatggggtcccataatgcaatagttttacctgcgccaaatgcgacgatttttttaactttgtgtatatcgctaacctgagtttgcttgttagcacctataaaaatggcttcgggagtgatacattccaccatgattatggaacgttaactatataaagtttttgcaggaactgggatatacaaatagatatactagtctctacgtgcaattgtaagctacctctgcccatcgcctaatattaaaacaaaaaaatttttcatctatttcaatatcggacacttttcccgtcacgtggaaacggctgacaaggttaataagaagaaatcgcttaaaggaccgacccaggctataaattatactgatctttatacactatactcttatttaatgggttgcatctcagtctcacacattttgaaactctcaaattcaccttcaaaaaagcgggacttaattactcgattaaaccagcgcgtaacctctggatgcttagacctccatgtttcatcgaaaaaacttataaaccctagcgaaaaagcagccgctgagattaaatcagcaagagtttcgtggtcatcacagacaaggtattgctgtttctttaaccttttctcgtaaagcgaaacaatggtgtcgacattctctcttgcggctttgaattcagtggcattatatggctttacgccaattagagggaaaaacacctcacaaacctcattcaagaaatcactgttggaaagcgattcccatcttaaaatatctgcacgagttttgaagtcaccttcgggacccaacaactggcgcacagcttccttgtcgctcgacagatggatcaagtagtagtcaatagccattgcctctgtaagcgtccactcgtcatgcggtccaacaaaagttgggtacttacgcaagggaaactccctttcgtaaagttgctgagcgtcacttggatcagcaagcttaacgtccagcttcaaggaacgcactaaacctcttggcacaatggtcctaatcaactttctctccttcaaatcagtaaacagtgttccgtcagacatttgtagttttctacacaaagatgccgaaatcaatgatgagcaagtatcgagttcgcttcgcactgctacatctaggcttttataaggggtggtatcgtttaaaggtgcggctattaaaagggatgaatacgtgggaaacggttgcattacaggaaaaacagctttttatcttattatatctttaaatatgtacatacgcttgtttatacgtggaggcgacaaaaagggttggttgaagggagagagaaagagacgcacagagattggaggaggggctcagttcgctgattgtttcttcttctgtgttaggttttccaaagttaacctgtcgttgtcgtcgtcatcttcactgggaggcgttgagttagtgtttgaatctgaatctgaatttgtattcgtgttgttagaatttgtgtcttcatcatcttcctgactgaaaagatttccattgtcatccggtgatttagcggtagagttttcgcccgtaaattcgttggcaaactctgtagccggagaggcctccctgattagcttcctagtaaacggatcatccaaaaaattctgttttctttgtcgttgattttgtttctttaattcattgcctattaacttggagtagagttttttgcccaacgttttctttagcaagatttcacggacttcgaagtacaagtctctggaggcgttattcaaatttgtctggtttttcttgaaatatgacctgaattcattgatgtgttttttgaactccagttcgtttttcttcaaccaagaaacgttcagctcctgtctggtagcaccccttgcaaagtttctcatcaaatatttgtcataatctctgatgatctttgtgataatatcacttgtagagacaccattggttctttgggtagtcaagaattttcccatctcctttattggcttgtagatatcgtcgctgtcggcgctaacgtaaggaatatcgtcatgtgccacgtagtcaatcttgtgttctagtagaaattctggggtgacacaccagggagcgttgggcacgacttcgtcaacccatctgcagtgcgttaaagtttcacaacgctgcttatcggtcagcacagtcaaaccttttagtttgtgagtgattttgtcgctaggcacaccaactatcagtgttacattggggaaagccttcttacactgttccagttgcttcatgtggccaagatggaaaagatcaaaaacaccatctgcatatatcctgatgggtctatccgttggaggcaaattgaatctgaaacctttaggacgatacttgcgcagttccttgggcaactcgttggtgtaacgagcctccttctcttcaaactccttcgtcaaccggcgacgcttgcggggagtgagctgtgtgtccttattttcatcctggttcttactctcatccttatcctcattgtcctgctcttccgtttcctcacgctgtcttttatttttattttttttaaataggtttgatagcgatgagttagaaagcttagccctaatcgaggacttccctgttgttgggtttgccatttttctttgtgtctgctgtgctttgtactaccaagagagaatagcaagagtgaaatttgaaagttaaacaatacaataaagaaaagtgactggcgtatgcaagaaaggggaatgggtataaaaaatacaagaacggcagaaaaaataaaagaaacaggagaaacaaacaatggtaactgtactaaaaccaataccagatatatatttcatacttattaaaaagcgttaagaaacgaagcgtaaaaacgtaagaaaaagaatgactatataacggtaggtcttcgactcatttttttcttcctacatgcaaacgacaaatacgggtaatgcacatttcgcttattgggttcttccctttccttttttccatttttttctttctggctgtcgctagcctttctacttcctccgcacatacagttttcagcacagtatagatagctgtgcagccagatagaagcaaaagagaagtcaattgcaaaaaaaatatggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgttgacaggtttacacaatcgcacgtgatcatatatttgccatgactcctcccagtgacaattttgttcttttttcctctttatcgctttcgtactatggtcagtcattcattcattatatacgcgctctccataacccgtaactttttattatatatagactcgtttacaatacaacgatagcgataccattcaattgaagttgtgagaccaggtaacgagacgaacacaactttacaagtcaaataagaaatcatggctggtcaagtgttggacggcaaagcatgcgctcagcagtttagaagcaatattgctaatgaaatcaaaagcattcaaggtcacgtgcctgggtttgcacctaaccttgccatcattcaagtaggcaacagaccagactcagccacatatgtacgcatgaagcgtaaggcagctgaagaggccggcattgttgctaatttcattcatttagatgaatccgctactgaatttgaagttctgcgttacgtggaccagctgaatgaggacccacatacacacggtattatcgtgcaactaccattacccgctcatttggacgaggatagaatcacctcgagagtgttggcagaaaaggacgtggacgggttcgggcccaccaacattggcgaattgaataagaagaacggacacccattctttttgccctgcacgcccaaggggatcattgagctgcttcacaaggccaacgtcacgattgaaggttcccggtccgttgtgatcggaagatctgacattgttggctctcctgttgcagaattgttaaaatctctaaactccaccgtcaccatcactcattctaaaacccgtgatatcgcatcatacttacacgacgcggacatcgtagtcgttgccatcggccaaccagaatttgtgaagggtgaatggttcaaaccaagagacggcacttccagtgataagaaaaccgtggtaattgatgttggcaccaactacgttgctgatccttccaaaaagtccggtttcaaatgtgttggtgacgttgagttcaatgaagcaatcaaatacgtccatctaatcactccagtgcccggtggtgtgggccccatgacggtggctatgttaatgcaaaataccttgattgctgccaaacgccaaatggaagaatcctcgaagcctttgcagattcctcccttgccattgaagttgctaacacctgttccttccgatatagacatctccagagcacaacagccaaagcttatcaaccagcttgctcaagaattgggtatttactctcatgagttggagctgtacggacattacaaggccaaaatttctcctaaagtcatcgaaaggctgcagacgcgccaaaatggtaagtacatcttggtgtctggtatcacaccaacaccactgggagagggtaaatccactacaacaatgggtcttgtccaggcactaacggctcacttgggcaagccagccattgcgaacgtcagacaaccctccctaggacccactttaggtgtcaaaggtggtgctgcgggtggtggttattcccaagtcatcccaatggacgaattcaacttacatttgactggtgacattcacgccattggtgcggctaacaacctacttgctgccgctattgacactagaatgttccatgagaccactcaaaagaacgacgctaccttctacaacagactagtgcctagaaagaacggaaagagaaagtttactccctccatgcaaagaagattgaacagactgggtattcaaaagaccaaccccgatgatctaacacccgaagagatcaacaaattcgccagattgaacattgacccggacactattactatcaagagggtggtcgatatcaacgacagaatgttaagacaaatcaccattggtcaagcccctaccgagaagaaccacacaagagttactggattcgatatcaccgttgcttctgaattgatggctattcttgctctttcaaaggacttgagggacatgaaggaacgtattggaagagtcgttgttgctgctgacgtaaacaggtctccagtcactgttgaagatgtgggttgtaccggtgccttaaccgctttattaagagacgctatcaagcccaacttgatgcaaactttagaaggtactcctgtcttggtccatgccggcccatttgccaacatctctatcggtgcctcttctgttattgctgatcgcgtggctttgaaattggttggtaccgagccagaggcaaaaacagaagctggttatgtggttactgaagcagggttcgatttcactatgggtggtgaaagattcttcaacatcaagtgccgttcctctggattgacacctaatgctgtggtcttggttgctactgttagggcattgaagtcacacggtggtgctccagatgtcaaacctggccaacctttaccttccgcatacactgaagagaatatcgagtttgtcgaaaaaggtgccgctaacatgtgtaaacaaattgccaacattaagcaatttggcgtccccgtcgttgtcgcaattaacaagtttgaaactgacactgaaggtgaaatagccgccattagaaaagccgctttggaagctggtgcatttgaagccgtaacctctaaccattgggccgaaggtggtaaaggtgctatcgacttggccaaggccgtcatcgaagcttccaaccaaccagtggacttccatttcctatatgacgttaactcctccgttgaagacaaattaactactatcgttcaaaagatgtacggtggtgccgcaatcgatatcttgcctgaagcacaacgcaagattgacatgtacaaggaacaaggtttcggtaacttgccaatttgtatcgccaagacacaatactctttatcccacgatgcaactttgaaaggtgttccaaccgggttcactttccccatcagagacgtcagattgtctaatggtgctggatacttatacgctcttgccgccgaaatacaaaccattcctggtttggctacctatgctggttacatggccgtggaagtcgatgatgacggtgagatcgatggcctgttctaagacaacttaattatatagaatttaataaagacaaatgcaaaagtttttttaaagtatggatgtataataataataacgataatacgaacactattgggactaataatgatttatagttttttttacacaggggatttaacgttccgcgaccctttttcctttaatttaaccccagttccttaacgtcgaaaatttccgattccgttaaggaggagaaaacctaattaccaaacgaagcggggagacgcattaatgagaacaataaatgtatgaaacttttagcaatctaaatgatactataccaagacaagcgaacactggctagcacaatatttgggcggaacgaaataaaataacgaagatatacataagacacaaaggaaaaagcgttccattgcatctctgaagtgaataatataaaaagtagtaaagctagaaatgtgtgataagtcaaaaacggtattggactacacgatagaattcttggataaatatatacctgaatggtttgagacgggaaataaatgccccttgttcattttcttctcgggcccacaaggctcaggcaaaagttttacaagtatccaaatctataaccatttgatggaaaaatatgggggtgaaaaatctatcggttacgcctcaattgatgatttttatttaactcacgaggaccaattgaaactcaatgagcaattcaagaacaataagctgttacaaggacgtggtttaccaggtactcatgatatgaaattgttgcaagaggtattgaacaccatcttcaataataatgaacatccggatcaagatactgtcgtactacccaagtacgataaatcccaatttaaaggagaaggggaccgttgccccactggtcaaaaaatcaagctaccagtcgatatttttatcttagaaggttggttcctcgggttcaaccccattttgcaaggaattgagaataatgatcttcttactggggacatggttgatgtcaatgccaagctcttcttctatagcgacttgttgtggcgcaacccagaaatcaaatctttagggatagtattcaccaccgataacattaacaatgtttatggctggagactacaacaggagcatgaactaatatcaaaggtcggaaaggggatgaccgacgaacaagtgcatgcttttgtggatagatacatgccctcctataaactttatttgaacgactttgtccggagtgaaagtttaggttccattgctacattgacgttaggaatcgactccaacaggaatgtatattctacgaaaacgagatgtattgaatagtgatgttatgacctttttttttacgcctttttttttaattttatctcacttttcccttctattttatgtactaacagataattttataatgatttcatgtatttttggttcagaattttgacaaggcaactcttgaataattgtcgtatgcaaaaaaaattgtttatctgttacatatccatcataaaacttttatagagcttttattgtccttcttatacaaataccgttcagaggctgtccgagatttaagcggttttggaaaaattactgctattaattaagattaaaaaggaaaggaaaatagcaatgggagcttatcgcataaaaaaatgaacaataatgttgaagaactcctacggcgtattcccctctacaacaaatatggtaaggattttccacaagaaacagtgactaggtttcagatgcctgaatttaagttaccagcgctacaaccaacaagggacttattatgcccttggtacgaagaatgtgacaatatcaccaaagtctgtcagttacatgattcttctaataagaaattcgatcagtggtacaaggagcaatatctgagtaaaaaaccaccgggaattgttggaaacacactattatctccatcaagaaaggataattcctagttaaattgcatttcgatatctatgtacacatatacagcaatttttttttataaaccttagtaatattatcagttttcattttatgtcatttgacctttgttgcatttaaatggccttaacttcttttaacttttcaatcaattcatccacagaattcaatttcacaccaggtgacttagtctttggctcttccatcgacactatctttaactgaggttcaatattaatttcaggaaaatcttttgctatatccaatttttcaataggctttttcttcgccttcattagtttgggcagtcctacgtaacgcggagtgttcaatctcaaatctgtagtaataaccattggtaaggaagcttcaattacttcttctccatcgtcaatttctcttgttacctgaactctaccattatcaaggaattccacctttgccgcatttgttgcctgtggccaatttaataaacctgccaacatctgaccggtgttgttacagtcatcatcaatggcttgctttcccatcaaaaccagattagaacccttcttttcaacaacagcttttaagattttagcaattgctaagggctctatgttttctttacccacagagtcaattaaactacaggtgtctattcccttagcaaggcaatttcttagaatatcctgagctttggcggagccaatagaaactgcatgcgtagattctactaaactcttgttcttttctttaattctgatggcttcttcgacagcaatatcatcgaaagggttgatactgaatttgattccactggtttcaatcccagttaaggtcttatttactctaggcttgatctggaaatcaactacccttttcaccggaactaatatacgtagttgctgttttgcagacatttttattactctttctgatacttgattatcggggttattgatcctagtgtgtcttgacaacgtttctcgaatcaggattattttacaccgagaaagaaagagtcaatactaataatctcgaaagatcttcaagtgaaaaataaaaaaaaatgataaataaaaaatagaaactatgaaactatgtaaaaaaaaaacaaatagacatatccaagcaagtccaatagcatagacattaagcacgacagctgtaaaaaatgtcaaagtttgttatcacctgcatagctcatggagaaaatctcccaaaagaaaccatcgaccagattgcgaaagaaattactgaaagctcggcgaaagatgtatcaatcaatggtaccaagaaactatcggccagagctaccgatatattcattgaagtcgcaggatcgattgttcaaaaagacctcaagaataagctgacgaacgtcattgacagtcataatgatgttgatgttattgtttctgtcgacaatgaatatcgtcaagccaaaaagctctttgtctttgacatggattcaacattaatctaccaagaggtcatcgaattgattgccgcttatgctggtgttgaagaacaagtgcacgagatcacagaaagagccatgaacaatgaacttgatttcaaagagtctttaagagaacgcgttaaattattgcaaggcctccaagtcgatacactatatgatgaaataaaacaaaagctagaggtcaccaagggtgtgccagaactatgcaagttccttcacaaaaaaaattgcaagctcgctgttttaagcggtggttttattcagtttgccggttttatcaaggatcagttaggtttagatttttgtaaggcaaacttgttggaagttgacactgatggaaaattaaccggtaaaacactgggtcctatcgtagacggacagtgcaagagtgaaacccttctgcaactatgtaatgactacaatgttccagttgaagcaagttgtatggtgggtgacggtggtaacgacctgccagccatggctaccgccgggtttgggatcgcatggaacgccaagccaaaggtgcagaaagctgcaccttgtaagttgaataccaagagcatgactgacattttatacattcttggttacaccgatgatgaaatatacaatagacaatgaagaaaataatgatagatagatgtaatagagtttctttttaaaattgtttatttaaactggtaaacatgatgtactttacgtagcgttaatataccggcaactatacgttggaagcaatagcttgcttgatagcagctgggttggcaccgacgactctggtaacctccttaccgcccttgtagaagattagggtaggcatggaagaaacttcagctttttgagcaacatctgagacttcatcaacatccaacttgtaaaaagcagcgtcagaatattgttctgcaaacttttcaatcattggtgcaatcattttacatggcccacaccatgtggcaaaaaagtcaacaacgactaacttgtcgccagatgctaaagcactgtcgtattcagaagcggattttaattgagtgaccattattgatgtgttatttaaagatatcgtagactctcgtgtatgtgtgcgtgtataattcttgctagacaacaaataaaaactggtcctcgttattctcttgtcagcttttcatcccccgaatggctttcttatatactgatatccctctttcggctggctggaaactgaacgcgcttagtaagaaaagagccaccttgtagggagcatcctttactaagagtataaacaattacacatatactttgatgattacttaatattcactggcactcaagttatgctgatcttggagcgatcttgaagccgagtatgtcattcttaccgggctcaacaagactttcttcactgactctcacgccgccaacggtttcaatgcttgcaatggtgacctcgccacccatgatatacctggcaactttgccaacaggggttcctcgcttgaccaaaaaacaatctctaaatacgttggttccgttgccacccgtaaaagtctggatgttcttcacagtgtacaccggtattagaccaaggatgtccgttgctgcttgcagaacctgaacaacacccgtagatccgaatctatacaggaccaaatctctgatattttcaattctgttaaggatcttgtcgtccagtggctttagtttgtctggctcgtcctcaaatgtgtcaacaaattccgtgccctcctcgtataatataaaaccttgctttttcaatttcctcaaaaaaacttccgtcactgcactggtcagtacagctttggtgtcaggatactttagcatgattttagaaacatttttatcggcgtcagggtggtcaatcttgttgagtgccaacacagttggaaatttctccatcataaaggacttgaccactcgagtgatccattcgtcatcccatttttccaaaggtggtagtcccttcaacctgtccagggctttttggatcatgggcgcatgtgaaccgtacccaccgaattgcgcttgaagtgtgtccactatgctagatttcgttgctgtatgtttacgcacaatagacccccatcttttcttcaggttcccctcaacccaaagcctgatttcgtcttgcagccattctatatcgttcaatggatcatatcctcttgtgttcttcccctctgcatctgtggttccactaacgtccaccacatgaataagagcatctgcgtgtcttaaatcatccaagaatttatttccaagccctctgccggaatgcgctccaggcacaagccctgccacatccaacagtttgatggggatatgcctcttacccttgctacaccacccgtagttaggtttacaaagatcttccttgccaaatctggagcaagcacactcaacttgcaagtagccggttgcctgatttggctcgatcgtggtaaagggaaatgctcctaccgccgcacctgcgtccgtcaaagaatttaatgtggtggatttccctgaagatggcttacccacaataccaatcaatggatccctgggcatactggctctatttccgttttattcttacagacagcttatactacaagttagttggacaaaagctaaaagacggaaaacgaaaacgcaaaatgaaaataaaaccaactctcattacaattcatcctagaacacttacacatctgttttgcactgcatagcattacatttcttgcatatctatctattcgagaaaaaaaaaaaggcatcgagtgaatttttcaccttgataaaaaagcccttactaaccctacaataaattgtgccgaaaccctctggagttttctagaatattctagccccatcagggctagaatatcctaaaagtttatagttgacgaaaatttttcagcgatgagatgcacatttataatgctatgatgttcaacgcaaaggaaatcatagcgttatcgggtaggttcgcatcgttagcaatagctagtcgcatatatacacagagatacatattatacctataccgttaagaaataggatagaaaataatgagcgaacaaaaggaagatttgtttaaaccagtaggagaagctgctgcagaggtcgaagatgaaagcatagccgaacagaacaaagctaatgacggcgtcaagttaaccggcgcacaggacgccatgggccatccagtgcaagagatagagtctctttgtatgaattgtggaaagaacggtacaaccagacttcttctgacttccatcccttatttcagagaaataattattatgtcattcgactgtcctcactgtgggtttaagaactgtgagatccaacccgcttctcaaattcaagagaagggctctcgttacgttttgaaagtggagtgccgtgaagattttaacaggcaagttattaagtcagaaactgccacttgtaagtttgtcgagctagacattgagattcctgctaagagaggtcaattgacgacagttgaaggtttgttatccgagatgatcgacgatctgtcgcaagaccaggaaatgagaaaatctatagacgaagctctttacaagaagatcgatgacttcatacagaaagttaaatcctacatcaattgtgaacccaacactattccgattacatttattttggatgatcctgcgggaaattcctggatcgaatacaaacccggtgaacctcaacacaaatggtctcatacccagtacgtgagaaccgacgaacaaaacgttcaagttggcattattactagagaccagttggagcaacgtcgccaagaacaattaaaacaattggccaaccgtgaaagaaatccttctgaatctgtcaaagttggctcagcaaacccacagtttttgtcagacgccaccgacatcgaaaactttaacaacgaggtgcaaacattcagagcttcttgtccatcgtgtacccaagagtgtgaaactcatatgaagccagtaaatatcccacactttaaagaagtcattatcatgtcgacggtctgcgatcattgtggttataagtctaatgaggtgaagaccggtggtgccatccctgacaaaggaagaaggattactttatactgtgacgatgcagctgacttgtcccgtgatattttgaaatctgagacctgtagtatggtaattcctgaattacatcttgatattcaagaaggtacattgggtggtagattcaccactttggaaggtttactaagacaagtctacgaagaactagaatcccgtattttcactcaaacttcggattccatggacgaagcaacgaaagcccgctgggtagaattttttgccaagctaaaggaggccatcgctgggaaagtcaagttcacagtcattatggaagatccattggccgggtcgtacatacaaaatgtctacgccccagatccggatccaaacatgactatcgaagattatgaaagaactaaagagcaaaatgaagacctgggattgtccgatatcaaggttgagtaacgatcgttggcctcggtatcacctccccctttcctcttcctctttacatatatcctaaccacacaagcactcatttgatatgataatacttattcgtttttattcaaatagatagcgcagtcttgaagatttacctatatttttaaacttttgtataatagttgaaatagataatacagcattttttggctcctgcttcatatctttttttttaggtttttgctttatattctttcttttaactcaacttgtgcggagcagaggtaaagaggacaactataaatgctgtcaaaacgaacaatctacagatatttttacgaaaaggaaaaagcgcaagaatgaatcttaaactttctgctattgaaagttactttttccatagaagcagactaaatttgcattcatgtttttatgtcggaatcaaactcaacgaattgcccaaaaaaagtcaactgatagcggctcttaagtatactgtaatccaacatgaacgtttgacttgtaatgtattctatgatgaattgaaaaaggaaaacttcctacaaaacattcttgagccactgaaattttgcgatctagtagaataccgccacgattgggaccagttaggggaaaccgaaattaaccacatctttcaaaggtataacttttcatacaacgagaataaacctttatggaaaattctgatcctccctaatcaaaatcaaatgctattgctgacagatcatgttctcatggatgggatgtccgctattcatgtgtgggaaacgtttatggaaggcctacagatgcaacagccggttgaaattgatgaaacaatatattcaccatcattaaattcatcaactgaaaaaataatgtcagccccactatacggagattggcccataccttggaattggcatatagtgcgacaattggtcagtagactacattattggtttccacaaacagtcgtaaaaaacaatagaaatttaatccaatttgccaactactcatttccaaaagacctgctggatgataaaccgagcgatggaactcaaaaatacaaagttaaaaacacgaaccatcaatgggagtttcgattatcgccgacccatctcaacgacattttacaagaatgcaaggccaataatacttcgttgacttcccttttaggtgccctggtctgcaccagtttcgaaaaaatagctgcacatgagtataccggatcatttttgaaaattgaattaccaatgaatattagaaagccttttgaacgagtcttgaaattaccttcagatgataagctcgccgtgggaaattttattgcggtcatagaattcaaccataaactacatcaaaaccgtggaatatgggatatcgcttctcaaattcaaagggccataagaagcagttccgaggataaaataatagataaagtaaacgaagtaaagttattggaggttatttcttctcaacaatacatagaagataaaattagcttgaataacggaccttcttccacatttgaagtaacaaacttaggatttcaaacatttaaagatgcatgcaacaccagtttaccgttttatatagtggatgctacattcaacgagccgcaaggaatatcttcaattttctcactaagcgtaatctctactcctggtaacggactacattgttgtatcagttatccaaatactctcactaaagtgctagaaccccactggcaatatatgaaagattacttaaatttatactagcagcacttcactagctcaaatacagaataaaaccacatttcccacatgtaaatatagaaagcagtttattcgctctttgaagcgagatcttcttcgatagacgtcacctcaacgtcaggatagtcggtgccgtcaaatcttgctgattgttgcgcttgaatagactcttcatgtattctaaaaatgttaattagtgggaacgccacaataaaaattaatacgagtaaaaacattggtaaaccatcaaaaatataaagataccactcgtgcgaggcaatttctccgtcataaccctgaataaattcaacagctctgacgatcgacctaattaaaatcaggaaactgttcaccaataaagcaatgtttaggtatttccaactaccataccttaccgatacattggttggttttttgctcatcttgaaaatgaacaaaacctcatttataatgaagagaccaaaaaaagcaatttgaatgaacaaaccagctgtaacgagatgagaaccagaagatgcacttgtcactttagacatcatagcaccaccaattgcttgtaatagaagactgcctacatcgccaatcacaaatattgtagtattgaatctagcgggcatgatcattaagttttctgcgaacagcagagtagccattctaccaaaaatcatgtaaatactggcagcatataatgttggagacaccagcaagaaaaccgtttgaataatataggggtttagtagtgtggtgtctttgcttgatttacatctaaacgcaaagcccacacactcaacaaaacacccaaatataaagggaatgtacgctcctgctaagtttaccgtaccgtaataccgcaatacgggttgggacttcataagagagccaactctccttttacttttcacagaataatggaatagtaaaattacaaatgctacccctgatactgcaaaaagtaccgtaaaaagtatactcgcacctaattccggagtgtatctatataactcgaagccgtcttttgccatgttcgaagtggtgaaaagtgctgactgtctattacatacttttacagggtttattattatagaatgaaacaggcaaggtatcttatccctttattatgaaaactatatatacgcataagtcttttgctgcatgataagccccttcccaagaatatgacaacctcttattgttcttttcaccaaagatccacggaactcatctttagcaagtgaggcttgaaatatcacagatatcattgtgaataccgcattgagcagattgttgacagcgggcatcttactaacaggcgcaatctaaagaagccgcgaaaaaaaaaagaacacgctaaacgattcacccatgccagccaagtgtagatttgtttgtagaggaaaacagttgatgagcaatttacagtgtttttttatcttagtaatattcatcaaaattcataggaaatagtcaatgatgcatgtctgaaaacaaaacgacctatataccttattgtggcttgtaaagtttaaacttaaaaataaactttctttttgaatgatagatatttccgcttttggatgcgcttcacaagaatagaagcaaaaagtccggttaaaattgaaatatgataaaaacccaaacatattaaaaaacccagacataaagaaaaaaactttgaaaaaaaaagtattatgccgctgagcgcgccacgttaaaagctcgaattcttcgcattggtagtagcgcaaagtccaatgagcgcacctcaagtgagaaacgcaggcccagagattctccaggcaggaaggaattgggacagatcctgcctggagggatggaggaatttacttcgtaggctggaacaggctcatctcagccaacgattgtaaatgtgcagggccatcgttacaatcctgcgcaccctaccatggataccagaatcccgtcgtgttcccaattgtgagtagtacagtggcctgctgccgggcagatagtagcagggcaggacacttgccagatcccgtagcaaggatgcttataatatatcgaaatgtagcattgttagtttacttcgtaaactgcccttgtagagtgaggtatagcttagaaaatagcaaactaaatagagagcgaaatgtccttaccagctacttttgacttgactccagaagatgcccaacttttgttggctgctaacactcacttaggtgctagaaacgttcaagtatgttatactcattcccgattatataatagagtaatgtgtgattgaaaacagttcgagtgaaagaatagccacaaccaggtttcccgccaaccaaacggaatgctgggatagcatttttcaggctgaataagaagagaaatatatgaacaatcattaaaacagtttgaaactccagctaattatcagcgaatattttgccaatagactttctaattgtattatgttattaaattttaaatcgctaatgaaaaaaaaaacaaacctttggtattaaacctctttcaatgaaatcaattaattccggtacctattcttccgacgctgttagccaactataaatgccattttttcatagtacattaatttgaatcagttgatcattcacagcatataccaagtgtacgtttttgaatcttttatactaactttttcttctttaattttgtttcaggttcaccaagaaccatatgttttcaacgcaagaccagatggtgtccacgttatcaacgttggtaagacctgggaaaaattggttttggctgccagaatcatcgctgccattccaaacccagaagacgttgttgccatctcttccagaactttcggtcaaagggctgttttgaagttcgctgcccacaccggtgctaccccaatcgccggtagattcactccaggttctttcaccaattatatcacccgttctttcaaggaaccaagattagttattgtcaccgacccaagatcagatgctcaagccatcaaggaagcttcttacgttaacatccctgtcattgctctaactgatcttgactctccatcagaattcgtcgatgtcgctatcccatgtaacaacagaggtaagcactccattggtttaatctggtacttattggctagagaagttttgagactaagaggtgctttagttgacagaactcaaccatggtccatcatgccagatttgtacttctacagagaccctgaagaagttgaacaacaagttgctgaagaagctaccaccgaagaagctggtgaagaagaagccaaggaagaggttaccgaagagcaagctgaagctactgaatgggctgaagaaaatgctgacaacgtcgagtggtaagtaaggtgatatttacaaatagtatattaataattatagtataatgttttattagaataacagatttctttatcaatttagcggctaaataaaaatcaagaaaaaagaaatacattcattgtgtcatcttgtcacacatttagccatgtactttatttgctgagaagtttaatcaattgagagtagttagctattgtagtaaaaatgtgcaaatgaagtcttatcaacacgtagcgtatatagtgatctaaaacagttagaaatataataagcgaacttctaaaccattttagagcacatagccatggagaataggtacttgttttgacccgctcgacgaagtggtacgtagtgattgcgtggattagtttatcataagactttcaatgaacgtaccaaaggcgagactcctaaaagtagcagagttatctgcgaagatatttgatcaaaatttcaacccatcaggtataagaaccggttctaagattctaaatgagcgattaaagggcccttctgtggcaagctactacggcaatccggatatcctgaagttcagacatttgaaaacattatatcctgatattgaatttgtagaccttgaggagcaatatcgattatctatggtagaagcaaagaaacgtcgtggtaaaggtgctcctaagaagatgaagaaggatgcagctgcaactgcaaaggggaaggggaagaaaaaaaaatgattggagcacccttactaaaaaaaatattcattatgtagaaactcatttcatgtacatacaaaatcaaaaataaaacaacaaatagctgaagcaagaaaacgctactttacttataaaagaaaacgttatgcctgaatagtcagccttttgtataaatcctttacactcaatggcttactaggcagtgaagaataaagaacatagtacagcttatttctattgaccattatagactcccctcggacaatctttcgtacagtagcaaacgagaaataatttgtcctcatttgcgacaacaatagattgtatggtctgaacatactcttgaatttaataggattgttttgaagttctaaggttgtatgcttgttagaaaccgtggttttgagctcaattgaaatgccaccgggtagacgtttaggatcttttaacctaagtaataatgcgaacaatggaaaatggttaatgagtgcaatgacagcttccgagaatatttcgatagttattgttagcattctcaaaactgtgtatgacatatagaatgccatcactgtgggagtcaagaacactagaataataaataataatgttcccaatagcaattgatctagttgaaaatagttatggtcaatcctatttcgtaaaacgttcctctttttaccgcagaacaggttaaaaagactagccataatattcaactgacaatggtacagtttactgctgatacgataaaaaacatatattggaaaacttaaaattgcaaaaaaatcaatcgctagggaaacagcaaaagaaaagccaacgagaaacatcatatatatcgttaacgtgagcaaagatgatagggttttcggatcaatgagtctttttatgaatgtggtataagaaaattctatcacccaaagaaataattcgctcaaaaagttcgcaagttctgcatttaatttgatgccaagggggttatttgctaacgtttcagttattgtttttaatgaatcatataaaaaaaacttcaatactctatgggatgccgacaccaagaaatctcgattctcaataagtatggcccccaatattaaaccaaatgaaatgtcattaataataagccaaattgtattatacaataaaatataatcgggatagaatttagaaggcatatatgaatgtgagaattgactattagaattatctttttccaccatagagccaacattctgtatgttatccttcttattaatacgctcatactgtactgggaaatagcaaatttgttgacaacgaagatcgatttgctggacaaatgccgagtaatttaccaactgaaagtgcgaataatttaataacgaggatacgagactagcaatagagcagatcacaaaagtcaaataaaaaccaatttttgcgaccattttataaatacaagtagatgaacaccaagctgcgacactattaagcatagtacccctcaaattttcctgtgatgtttgaataaacgggtaaagctcatttaatgctttacaatatgcggggaatagattaatgatgttcaaagtttcactcaatttcttattatctctcttgtatcttggatgttgctctaatttagaatagttcagagtttcacccacactactatgaagaccaacttctttttctggtatgatgagcgagatgggatcagaagaatagaattgcataaatttcagcttgggtattctaaaatggacattacagggatcagcaactttgtagttccaaccctccgctccattgttcttagtagctaccactgaataagggggccgtatgcttacttcttctaaatactgaggttcgcaaacacctaagacaacaaaatgcgtcttctcaaatgaaattgccaaagctacctgaggtccttgagctgcggaattctcgaacaaggattcgtatggccagaaaatgtaatttggcatgtcatttaactgtataaaaccgcccctgaattcgaaggttcctgttcacagaggaattttcattctttttggtattatgttctggtaggtttttttcatattctacatttcggcattctcactgaaaataaatatagatgagatagaagatcatgaatcaatggttggtgacaagctaacataaggaaaatcaaaatacacggcattactaaatagaatatattgttagtactatgcaggggagaaaaaggacgcttacggaaccatttgagccaaataccaatccatttggggacaatgcagcagtaatgacggaaaatgttgaggataacagcgaaacagatggtaaccgtctagaatcaaaaccacaagctttggtcccaccagctttaaatatcgtgccaccagagagcagcatccacagtactgaagaaaaaaaaggtgacgagtacaatggaaatgataaagatagctccttaatctccaacatatttcgtactcgtgtcggaaggagtagtcatgaaaacttgagcaggcctaaactctcacttaaaacagcatcatttggtgccgctgaatcttcccggcgtaatgtttcaccctctacaaaatctgccaagtctagttcgcagtatattgatttaaatgatgaaaggctacgcaggcgtagcttcagtagttatagccgatcatctagtaggcgtgtttctaattcaccaagctcaacggataggcctccacggtcggcaaaggttttatcgctaattgccgctgatgatatggatgattttgaagatttgcaaaagggatttaaaagtgcaatagacgaagagggcctgacatggctaccccaattaaaatcagaaaaaagccgtcctgtatcagacgttggagaagatagaggagaaggagaacaagaatctatacctgacgttcatacacccaatgtaggagcaagcgctactccaggatcaattcatctaacacccgaacccgcgcagaatggttcggtatctgagggtctagaaggctctattaataattcaagaaagaaacccagtccaaagttttttcatcatttatcaccgcaaaaagaagataaagaccaaacagaagttattgagtatgctgaagacattctagattttgaaacccttcaaagaaaactggaatcaaggccctttgtgctttatggacattctcttggggttttctcgcctacgaatccgctaagaataaaaattgctcgttttttgttgcataggcggtattcgttactttacaacactttgttaacattttatgccattctcctggcgataaggacatataaccctcacaatgtggtttttttataccgtttctctaactggaccgactatttcatttttattttatcagcttgctttacaggcaatgatattgctaaaataattgcgtttggattttgggacgattctgaaatgtttaaagcctatggacgtgagtataaatcaatcttacagagatctggaattatgaaactatacatatatctgagagaaaagtatggtagaaagctaatagatttcattattccatttaggatcatatcgccgggagaagagacaaaatatcaacgaagttcgttgagtacttccctgacgaaaccttatggggcaaaggaaaatcagaggccttttggcaccccaagagcctttgcgagatcatcgtggaatagaatagatctggtatcttctgtcagtttttggctaggtatgtttttatccataaaaagttatgatacaaaaacaggcataagaatattcaagccccttgctatattaaggattcttcgacttgtaaacgtggatactggtatgccctcaattctaaggggattgaaatatggtatcccacagttggtaaatgttagttcaatgctagtttacttttggattttctttgggattttgggagtacagatttttcagggctcttttcgaagacaatgtgtatggtttaaccctgaagatcctaccgatacttaccagtacgatatgcaattctgtggtggttacctagatccagtaacaaaacgaaaacaaaattatatctatgaagacggatcagaaggttctgtttcaaaaggctttctttgcccacaatattcgaaatgtgtttccaatgccaacccctacaacggcagaattagttttgataatattgttaattccatggagctcgtttttgtcattatgagtgcgaatacttttactgacttaatgtactatacgatggattcggatgaaatggctgcctgtttgttttttattgtttgcatctttgttttaactatctggctgctaaatctactcattgcagtgttggtatcatcttttgaaatagccaatgaggagtacaaaaagaaaaagttcatatatggttctagaaagacaggttatgttgctcgcatagtaacaggctactggaaatattttaagcttaaggcgaatcagacaaaattcccaaattggtcccaaaaaggactagctatttattcccacgttgagtttatctttgtcatacttattatttgcgatataggtatgcgcgcctctgttaaagtatcgacttcggcaaactgtaacaatatccttctaaaaactgacaggggaatttcgattgttctcttcatcgaatcactggcaaggttagtattatatctgcccaatatgtggaagtttttaacaaaacctagttacgtttacgattttattatatcaattattactctggttattagttgcctggctgttgaaggggttctaggacatatgtatgcctggctatccatattccacatatccagattttacagggtgattatttctttcaatttaacaaaaaaactatggaaacaaatattgagtaatggtgttatgatttggaacttatcgtctttttacttttttttcacctttttggttgctataatcatggctgtgtatttcgaaggcgtgattcctccagaagaaatggcagaccagccatttggaatgtattcactaccgaattcatttctttctttgtttataataggttcaactgaaaattggacggatatcctatatgccctccaaaaacactcaccaaacatctcctcaacttttttttgctcagtattttttattatatggtttctactatccaactcagtgatcttgaacattttcattgccctaatatcagaaagcatggaagtgaaagaagaagaaaaacgaccacagcaaattaagcattatcttaagttcgtctatcctcagaaaatacaagaatatacacacgctagtttggttgcgagaattcgtaaaaaattctttggaggtcataggaacgaagatacaagagattttaagcaatttcttatgagaggaaccgcgataatgaacatagcgcagaatatgggggagttggccgatgaattcaaagagccaccttcagaaaacctatttaaaaagggcttatcaaagctcacaattggggttccgtcactaaaaaggctgagaatgtttgctaataatccattttataaaaatagtgacgttgtgtttacagaaacgaacgatataaatgggaggacgtatatcttggagttgaatgagtacgaggatgagaagctagattatttaaaaaagtaccctttattcaattactcatattatttcttttctcctcagcatagatttcgaaggttctgtcaacgcttggtaccaccaagcactggaaaaaggactgatggatcacgatttttcgaggatagcactgatctatacaataaaaggagctattttcatcatattgaaagagatgtatttgtattcattttcgcacttgccaccattttactaattgtttgctcatgttatgttacgcctctatatcgtatgcatcacaagatgggaacttggaattggtcctcggcgttagattgcgccttcattggtgccttctcaattgaatttatcgtgaaaacagtagctgacggatttatatattctccaaatgcttacctgaggaatccatggaactttattgatttttgtgtcctaatctcaatgtggattaatttaattgcatacctaaaaaacaatggaaatttgtctaggattttcaagggattgacagccctgagggccctcagatgcctcacgatcagtaacacagctcgtcaaacatttaacctagttatgtttgatggtttaaataaaatttttgaagctgggttgatttcactcagtttgctatttccatttacagtttggggcttaagcatttttaaaggccgtttaggtacttgcaatgacggaagtttgggccgtgcagattgttacaatgaatattcaaattccgtttttcaatgggatatcatgtctccaagggtttaccagcaaccatatcttcatttggactctttcgcaagcgcttttagttcattataccaaatcatttctttggaaggatgggttgatttgttggaaaatatgatgaatagttcaggaataggtacacccgctacggtaatgggttcagcagggaatgctttattcctcgttctgtttaattttttaagtatggttttcatcctgaacttgtttgtttcattcattgttaacaaccaagcaaggacaacaggaagcgcttactttaccattgaggaaaaggcgtggctggaatcccagaaacttttatctcaggccaagccaaaagctatcccaaatttaattgagttatcaagagttaggcaatttttctatcaacttgcagtggagaaaaaaaatttctactacgcatcgtttcttcaggtagtactttatttgcacataatcatgctcctgagtcgaagctacaatccaggaaacttgataggttatcaaggtgtttattttatgttttccactagtgtttttttaattcaagaggcacttcacatgtgcggtgaaggaccaagattatattttaggcaaaaatggaacagcatacgactcagtatcataattatagcctttattatgaacgctgtagcattccacgttccagcctctcactattggttccacaatataaaggggtttttcctgttagtgatatttttgtttattattcctcaaaatgacacactaactgaactattagaaaccgcaatggcaagcttaccgcctattctatcattgacctacacttggggggttttatttttagtatatgctattgctttgaatcaaatcttcggcctaacaaggttagggagtaatacgaccgataacataaattttagaactgtaatcaaatccatgattgttctgtttagatgtagttttggtgagggctggaattatatcatggccgacctaactgtgtcagaaccttattgctcctctgatgataattcaacctatacggactgtggatcagagacatatgcctatttgttattaatgtcgtggaatattatttccatgtatatttttgtgaatatgtttgtttcgttgattattggtaatttcagttatgtttaccgtagcggtggatctcgctctggcatcaacagatcggagataaaaaaatacattgaagcttggtccaaatttgatactgatggaactggcgagcttgagctgtcctacctcccaagaataatgcattcatttgacggtcctctttcatttaaaatttgggaaggtagattgacaataaaaagtctagtcgagaactacatggaggttaacccagatgatccatatgacgtcaaaatagacctgatcggactgaacaaagagctgaatacgattgataaagcaaagatcatacagaggaagttacagtacagaagatttgtacaaagcattcactatacgaatgcttataatggatgtatcagattctcggatttgttattacaaatacctctctatacagcttattctgcaagggaatgtctaggtattgatcaatatgtccatcatctatatatcctgggtaaagtggacaagtacttagaaaatcaaagaaacttcgatgtattggagatggtggtaacaagatggaaatttcattgcaggatgaaacgtaccattgaacccgaatgggatgttaaagatcccacagtatcgtctcacatttcgaatataaacgtaaatctggaacctgctccaggaattttagaaagagaacctattgcgacacctagaatggactacggtgttaacaattttatgtggtctccgagaatgaatcaagactctacgatggagcccccggaagaaccaatagataataatgacgatagcgcaaatgatctaattgatagataaattatataagggcatatttaagaggctttatagatgtaaaaatgaacaataagaataatttaaatttgttttattgagaggtgattttctagagcatgtcaaactttactattcagggaaaaaagaaaagaaaaaaatgcgcaagcccggaatcgaaccgggggcccaacgatggcaacgttggattttaccactaaaccacttgcgcttactgattatatcttaatggttgaagagatctgaataagttttatcttcctctgggcaaagaatactatacattgcaagagtacccattagaagggaattaatttatgcactctaaatcttttttgattattccggatattatttttgttgataattagaggtaaaaaatagtattaatgaagaaataagtattgatcttcttatactaaataagagaggtatataaaacacacgccgattggtcatattaatcatgaccaatataatagtgattccggtagttactatacattgatgtgacgactcatattcctcatatatgtacctaccatatcatgttcaactaatagattttaagcacagcttcagtattgtctcagcttctcgtttaacattccttctgcaataggtgcaatcacacttaaacgtatacgaggtgtacattaatatacgatgtaagcattatattgttaccatagcaactcatgtcactattaattactctcgttccaacaattttgtatttgaagctttaacgggtgttaaatgcacagccgatacggctcatccgaaaagtaacgccaattatattaacagcttttccatttatttagaatggcgatacaacggaaacatacgaatatgatagtactcaattgttgtgnnnnnnnnnnnnnataataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcatcatttacccatttctcatgttgtgtacacattatatacctcccagttactgtcaatcctctcctcttatatcgtttcaatacaaataatatattatgaagggcaatattacatcattacccggagatatatactatttggaatgatctttctttataagaaaaaaaaagaatttcgcagatttccctggctttccttattcttcctacgttagcattattatgaattatcgctaatagcaaaggcaaaaaagattatcaactgcaggatattcggtcacaactttgacatagatcttgagaacctcaacactattcatttctctggcctgattattttaagtaaagtcaatcattgttaagttttcttttgttcttttctatcattctcgctctttcaattacttacacctacaataatagacgttgacctgtgaaaggcaagaaacttaactaatagtataattaagaagaagttaacattttactctacattattgaaaccgctcactgacttcaaaaataggataaaaacataatatggaaggaattttggatttttctaacgacttagatatcgctctattagatcaggtggtatctacattctatcaaggttcaggtgttcagcaaaagcaagcccaagagattttgactaaatttcaagataatccagacgcttggcaaaaagctgaccaaattcttcaattctcaactaaccctcaatcaaaatttattgccctttccatccttgataaattaattactagaaaatggaaattgttgccgaatgatcatagaattggaattaggaacttcgttgttggtatgattatctccatgtgccaagacgatgaagtatttaaaacacaaaagaacctgatcaataagtcggacttgactttggtccaaattttaaagcaggaatggcctcagaattggcctgaatttatcccagaactaatcggcagttcaagttcctctgttaatgtttgtgaaaataacatgatcgttttgaaactgctatccgaagaagtcttcgatttctctgcggaacaaatgacacaagctaaagctttacatttgaaaaattccatgtcaaaagaatttgaacagatttttaaattatgttttcaagttttggaacaaggttcttcaagctctctaatagtggcaaccttagaatctttactgagatatttacattggattccttatcgttatatttatgaaaccaatattttggaattattaagcaccaaattcatgacatcgcctgatacaagagccatcacattgaaatgtttgactgaggtttcaaatctaaaaattccacaagataatgatttgataaaaagacaaactgtactttttttccaaaatactctacaacaaattgccacaagtgtgatgcccgtgactgccgatctgaaagccacttatgcaaatgctaacggtaatgatcaatctttcttacaagatttagcaatgtttctaactacatatctcgctcgtaatagggcccttctagagagtgatgaatcgttaagagagttgttgttgaatgcgcaccaatacttaattcaattatccaaaatcgaagaaagagaactatttaagacgacattggattactggcataatttagtagcagatttgttttatgaggttcagcgtttgcctgctaccgaaatgagcccattgatacagttatcagtcggttcacaagctatctcaactggatctggcgccctaaatccggaatatatgaaaagatttccattaaaaaaacatatttacgaagaaatttgttcacagttgagattggtcattattgaaaatatggttagaccagaagaagtccttgtggttgaaaatgatgaaggagaaattgttagagagttcgttaaagaatcagacactatccaattatacaaatcagaaagagaggttcttgtatatttgacccatttgaatgttatcgatacagaagaaatcatgatcagtaaattggcaaggcaaatcgatggttccgaatggtcatggcataatatcaacactttatcttgggctattggttccatatctggtacaatgagcgaagatactgaaaaaaggtttgtagttactgttattaaagatttactagatttaacggtcaagaaaaggggtaaagataataaagctgttgttgcatcggatattatgtacgtcgtgggccaatatcctagatttttgaaggctcactggaattttctaagaacagttattttgaaactttttgaatttatgcatgaaactcatgagggtgttcaggatatggcatgtgacacattcattaagattgttcaaaaatgtaaatatcattttgttattcaacaaccccgtgagtctgagcctttcatccaaacaataattagggatattcaaaagacaactgctgacctacagccgcaacaggtccatacattttacaaggcttgtggtattattatttctgaagaaagaagcgtagcggagagaaatagattattaagtgatttgatgcaactgccaaatatggcttgggacactatagtggaacaatccactgctaacccaacattgttgttagattctgaaactgtcaaaattattgcgaatattataaaaaccaatgtagctgtctgcacctcaatgggagcagatttctatccacagttgggtcacatctattacaatatgcttcagctatacagagctgtttcttcgatgatttctgctcaagttgccgcagaaggtctaattgctacgaagacaccaaaggttcgtggtttgagaaccatcaaaaaagagattctgaagcttgttgagacctatatatccaaggcgagaaatttggatgatgtcgttaaagtgttagttgagccattattgaacgctgtacttgaagactatatgaacaacgttcctgatgcaagggacgccgaagtgctaaattgtatgacaacagtagtagaaaaggttggtcatatgatcccacaaggtgttattttaattttacagagtgtatttgaatgcactttggacatgattaacaaagacttcacagaatatccagagcatcgtgtagaattttacaagttattgaaggtcatcaatgagaaatcatttgctgcatttttggaactacctccggctgcctttaaattgtttgttgacgctatttgttgggcgttcaaacataacaatagagatgtcgaagttaatggtctacagattgcattagacctagtgaaaaacattgaaagaatgggaaatgtcccatttgcaaatgagttccacaagaattattttttcatttttgtcagtgaaacgttttttgttttaaccgattccgaccacaaatccggtttttctaagcaagctttgttactaatgaagttgatttctttggtttatgataacaagatttcggtaccattatatcaagaagctgaggtaccacaaggaacttcaaatcaagtctacttaagccaatatttggctaatatgttaagtaatgcattcccccatttaacatccgaacaaatcgcaagttttctctctgcattaactaaacaatacaaagacttagtggtcttcaaaggcactttgagggactttttggtgcaaatcaaagaagtcggaggtgatccaacagattatttgtttgctgaagataaagagaatgcattaatggaacagaatagactagagagggaaaaagctgccaagattggtgggttattaaaaccttccgaacttgatgattagaggcggtggcgtatcattctttaaatttccaatattttttcccttttattaactagtctctaatttataaccacggggttttcatttctttttcacttcatattgtatgtaaattggttcttcaaagttccaatactctaatatagtactaaatactatttagccaacttcatggaaaagtaaagaatattatttgaagattcttaagtgattacccattttattgttattattgatgtatgtacatgattgtagtaaaatacttatacgccttatgctcaagtttttttgattgcatcttgaattttaacgaaactgtttttgggcccagccacagagcctttaacccaaataacattattttcatcgtcgactttcaaaactttaacattttggatagtaacatgctcgtttcccatatgaccaggcatctttcttcctggcagtaccctacctgggtcttggttttgaccataagaaccaccgtgtctatgcataatagatgtaccatgagatgctctcaaacccttgaatccataccttttcatcacaccagtaaaacctttgcctttgctgactgatctgacgtcaacatattggccttctttgaaaaaagagggtttcaataatgtgccaggtggtattaatcccttttcatctttaactcggaattcggccacatgctcttttgggttaacaactttagaagcgaaatgaccaagcatttgtctgctaactttagacaaatgccttgatccgtaccctacttgacacgcgaagtacccattgacctccgaagttctatgcattattacttcaacattattaacttctaatatagtagcggcgcttctttcaccagtagatttatcaaaataaggcatcattcccttcttacgagtaattaaaccgcatctttttggtagccattttctcgcatttgccagttcaggtgagtgattaatcgctggagcctcggttgttatactgttagcaatactaggagccactagaaaaggccgagtagaagaatatctaacatgaagttttgatatgctaaatattgatccctgtaggaacttcgacatggctatatttgttctctcttgctttcaaagagttgccctttctcgtcccagttgtcaatttatcgtccatatatttttcaataaagttcgtttgacaagggattacccgaaaacaaatatctcgcgactgtaataggagaaatggcattagcatttcaattaaggaaagaagaggatcatcgagaaacgaatttatggtgcttatttactgttacaacatttcatgattttgaattttatttatacatgtacattctcgtacggtgttatttcgtaattatgggatgtgcccagttgcttccttaagtcttccgtagaagctttaaaaggtaagatttcccccacactaggaggctgcaagatgtcagtgtcatccaataacccactaacacggaaatttattgcatttgacaacgttgacggcggttgtgataaagaagatgatgttgtagtggatgagttaccagggagatattgggcctttattaaatttcttaaagatcctgcaggcttatagcgaggtttcatagaaagttctgatgggttggtcataacaacactttgtctaagctgatatggaaggggcgtacaaaattgctttgtcaaagatgttgacggtattttcgtaggcgaactgtaaaacatttcaggatgatccattggattcaacgctgtcccattaagcctagctgtaggtacatgttttagtgtttttggaggtttaggccttcctttgaatgacgtcaaggaatgcgaagaggtggaataaatgaattgggtaggcgtgggcaaatctccgatgttctcataattttgaggatgttctaacgggaggggataattatagtagtaattgtcatcattgctctggttgcagtgatctataaaatatgtagaatattgctgagcagaagtaagatttgactgacccgaaccctccgaaagggcccgtacggaagcctttgcagagtgaatatggtccttagcgaccgtgtcagaatatattgatgaggtaattctcgttgaaagaccattcggtggtgggaatgtaagagatagagacgattcgggaatcactttttctctggttgctacttctgaatatactgacgatgcaatgtttttattctcttgtggtgccggcacttgcagataatcagttgcatcttcatattcctcattggcgctggaactggaatcaatttcttggacagttgtacttccgaagtgactctgttcaattaatgtagtatcatttggattgtcttgagagctcatatttacactttttcttgtagcgatgtttaatttagagtcacgccgtatcgaagaagttacagaggatcgtatcgtgctattacttttctcaaaataaatgttataaatgcttcttattctgtcaatattttcttcctcctctctcgaacactgaggctcgagcccgctacgactcgtataattcgatttaagtcgattatcgttgttatggctggacttttcatttacatcaggatttgacgtactatcacatctttgatcacagtcttgcccagtatttgagtgttgtggtgaaacaatcagctcagaattctctaacgattcgaaagaaatcttattcgaaaggtcaatgtgcttggaggggaccgataacttgctgttattctgcgaagccagtgaagcaatattataagcggagggtgcatgctcattgatacgcctcacataatctttgaaagattgtgagttttcgattgacggttgcaaaaaatcgtcataaccaccataaataaacctcttttctgtggcattgctgtctgagtttgcagaattcatagaagaatccatcttcggtaaatagtataaatcgccctcaaaatttgggtcaaaatcctgcatagaaggttcttttttgcatctcctatatactactattaaaacgacggatagtactataataatagcaccaatgggaacagcaacggccactgcaacagtgacgttagatgaatcggttcttttctgaagaaatgtcagtgatacgcgagatttgtctggtatagcctctcttttttggcaagaattttctttatagcggtagtgactaaacatggacgctttatagcatctaaagtaggggaagcactatttctcacttgcagttactatgaagtatatttcgatcgcacaagttgctttactatgctattgcagcctaagataaaggcaacaaccgatgaaacaagagtaaagggtatactcttttatgcaaatgctcctttacgcgactggtcattattgaacatcgaacactttcgaatagtttagtctcaaatgtatcgaacgcgaaactttaaaagcgcattcttgttcttttttcgcgacttgctcctgtgatcgtcttatttctgctccatattatctattctttacttaaagcttcctaaaaatgcagtcaggataaaagcaaatgcttcaatggagttaatatatataccgaaacaagaaaatgagttctatatatttgttccatggactcatgaatcaaatttgtagaaaaataaaatagaaaagataaacgccctccttactcattgagaaaaagggcagaaaagttccaaaaaatatggcaagcccacagtaacggacagctttacctgtttctatggagacaacacccggatggttctggtaaaaggcaagaaccatgttcgttataagttctataggcaataaaaggcccacagttcttgatgttgacctccctccgccattgatctgtaaagctgcttgcaggttttaaaacaaaaagaaagaaaagtattttaaaatatataggaggaaagaaacatttaacaaaaagtcttactatgcgctttttatactgagcactccgtttctacaaaattttcaattttttttttcatattcgttaatcgtgatgagaatactaacaccacgaactcaaataggaagttaacaatttagggtaggagtgccagactctacccattatccctttgtcatcgatgtaaagcagatatgaaggcttctagtaaagctattaaattagtactggaccatctgaagtccacgggaagagttcttggctccgtagagtcaggaaattcagcaacaataagtgagaaaacggcatctgttaataagcagcagcagttgcaggaaaagaaaccttctgtcctacaatatagaagctacaatccatatttagttaaggaggatttcctgtcaattctgccagaaaatttgtataaaaagaggggacaatttacaaatgagcttgactttcagttgatgaaagtcagggaccctaaatacttccagttcaaggatcagtattacttgttttttaatgattataactcgcttactgagtatatcaaattaacaaaacactcgcgaataaacaagatcagggtgaaaatgacgccattggcgcaacccttgccaaccctgttaacaaaattacaaagatattcaaaaaatctatataacgcattccgatcatctgagcaatattttgagggactaaacgaaaaagtcgatgttagtggagagttcactaccaatcagttacggagtatccttgattcggtggaagaaatagaaaataagtccgtattagtctggaatatacccactaaattacggtcgcacgatatattgaattatttttggttttacaacataaggtctagcttcaagatatactgggatgatgaaatgaaaagaaatctacgatttatatctttcgaaaactcgcatgacgcctaccgctttaaaagaaactatcatggattattggctaaagagctattgaccctgtcagaaaagggagatgcagctgactattcgctcgaaatggacgattccaaaatattaattgaacatcttagtgaatgaataacttgaatcttgtacgtaaatgcacactttctctatacatatatatatatttatattcatgttaaagctctctccatgattctctcaccaactcccatctggtgggctcacccgctgatttcgtatcttcgttcctcaagctttcattcaatgaataatgcgttttcgatgaatcttgttgttccttctccaaaataacaaatttctcccatatcccagaattttgccacaccagaaccaacgaatcgtcttgttctctattattagagtcttgacaccagccaattctacatctgtctttatagaactcgttatcgtgagttacatcaccactgttgtcatttctgtgagcgtcaaagattgggttctttaagtgagcattgcatatcgaccacacagagtccaaatacttgggcctccataggcccttcggtatataatttttcaagggatggctcgaaccattggcacgagagtggtctggtgtattcgtttctgtattggttgtttcaaaaatttggaaaatatgcaatgtttgcttatttgacaatacggccaacttactaccattggggctgaaactcatctcgtaaatatccgccttgtccacccctcttctaaattctttgattaaagtaccgttatgcgtactgaagattcttataagtgtaccctggacggaacatgttgctaccatggtgccttgacggttcagtctaaccagtttgatgggatttttatgtgctttaatgatggaagtgggcaaaagcgctgattccttcgggttttgtgaattatattttatttgtgataggtcggctacttgaatttggcctacgcatttattcgatgggaatgcaatgatttctaagattttagactgtgactgcgatgcttgcgactggagatgtttgctgctacaaacgacatagtccactgatccattgggagggatatccaaaataggacaaattctttgaggattggtttgaaattggaagatctctattgtgttctccaggactaccacaatatgaatcctagataaaaacacgtctttaatggaagacataaacttcaaagtaatcgtttccttttgcaaaagatcatcccagatgatcagtttatttagagcatgccttggtcgtttaccacctccgactagtgcgatgtaattcgtacgataaagcatcctggtatagccaatcccagtgcccctggattggttggtcgcagactctttaaatgttttcgatagcttactagtcaatggatctgtattgaaaatacgaaatccattctctaacgccacgctgaaacacgaatcatcttggttaaacgaaacgctcaaaaattttggtttcctcctgttgttgactgcctcccttataggtcgacgaacatccatctgctagttatgtatgcttatagttgtcctctaataatcgctgcctttccagatcttctggtttctcttccctttaacaatagcccccgcagtacgtattactaaggtaaataaatataaccggctttacaagccagaaagccgtgatcacgtgattatcaatttctttatttcatttcgctcagatactgccaaaagcccctgatcttgaacacaaaggtaaacaacgttaatatgaacctggctatcatcattaggataggctcattttctctttttaactcaggcccctttcttgcactgttaccataggatcttaccaatttgcattatttccgccaactagcggatatccgctgtatttccgcgcttctatatgctatggctggaaatacaataaaaagtgtcaagcagaaccactacattaatttaaagaaaaatgtcttatatcaaagaatcggcactgtatcaattgattatatataatgctagagtttccgtaccctcttgcaacgtcctttaaatcttgtatcttttcttctacaattgtagtaacaccacgtctacattagtatctaaattgcagcccaatgaaaggcgaacctaagacttacagcatgagcgacctctcatactacggtgagaaagcacaacaacagaacgagaaacagcaaaaacaatatgttgtgagacgaaattctacgcagtcaacatcaaaacaaaacgtgagcgtggtgctcgaggacaacgccagcgaaagtaatgaactacctaaagggtttatcttgtacgcatctttgatagcattggctttgtcgctgtttctggcagccttggatatcatgatagtttctacaatcattgaagaagtagctaaacagtttggatcgtactctgagatcgggtggttatttaccgggtatagcttaccaaacgctctgttggcgttgatatggggaagaattgccacacctatcggattcaaggagaccatgctatttgctattgtcatttttgaaatcgggtcgctgatctctgctttagcaaattcaatgagtatgctcattggtggtagagttattgctggagtcggcggttgtggtattcaaagtttatcgttcgtcattggttcaaccctggtagaggagtcgcagagaggcatactaattgctgttttgagttgttcgtttgctattgcatctgttgttgggcctttccttggaggagttttcacctccagcgtcacatggagatggtgcttctatgttaatttaccgatcggtggcctagcatttttcttattcctgttcttttataacccaggtttaagtacatttcaagagacaatggataacatccgcaaatttccatcacagtttatcgaaattgttcggaatgtagcatatcatttattgaaaatcaaagggtttagcaaacttaatgggtggagaaagccgttcatggaattgattttcatgtatgatattatcgagtttgtgttttgttcagctggattcacatgtattctattggctttcacatttggcggtaaccggtatgcttggaactctgcatccatcattattcttttcatcatcggtatagtcctggtagtgttagcaggtatctatgatttccttgtcttccccaaatttaatatagtgaaagcaacaccacattaccaaccattaatgtcatggacaaatatcaagaaaccaggtattttcacggttaatatagccttgtttctcacttgtgcaggatatatcagtcagtttacgtatattgtgcaatacttccaattaatttacaatgattccgcctggagagccgctgtacacctggttgcttgcattatttctacagtcgttacagcaatactttgcggtgctatcaccgacaaaacccgccaaatcaaaccgattattgttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataagttaagcacgatttagaaggtggcgagcctcaaagtgtaaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgatgaacgattagtactcaaagaacactttaatccttggaaacaaaaaaataaaaaatcaaaagttgaaggaaggtcaaattttcttcctccaacgataataatacttgcttatataactcttttaaagttttacaaaactttggatcagaaaaaaagaaaaaaatatggctactccccatttatatcacagatataactccaaaagctctaacaaaaatatcaattcgagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagattttatgaactgtggaacgataaggaggaaataattaatgaaattcaagagagtgggatttatggatctaatattatagaatatatggagggtatcgaaacaacacataacaaaagaataaggtaatataaaaaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatggttgagtgctttttttgctggtgtaagctgtctcttcagacaaacgaatatcatttggacgggatttataatgattcttgctgttgaacgcccagccattttacaaaaacagttcaacacgcatacgttcaataactatttgaaattattcattcatgctattgacgatttctccaaccttgttctgccctatatgataaattttgttttgttcttcatttatctgatttggaacagatccataacactaggtgataagtccagccactcagcaggcctgcatatagtacaaatattctattgtttcacattcatcaccgttttcagtttacctatatggatatctcgtaattttatgaagttgtacaaattaagaataaaacggaagccagtacaaactttttttgaatttattggtattatgctaatcataagatactttacaaaagttcacccatttttgttagcagataatagacactacacgttctacctcttcagaagattgataggcaacaaaagtagactaatcaagtacttttttatgacaccaatctatcatttctccactttcgcataccttgaagtgatgagacccaaccagctcacctttcaccccatcactccactccccatcaaagaacctgtacatttacccatacaactgacacatgtatcgtggacggccttaataacgtgcaccatggtaactatcgttccatcacccttattcgaacctcgttactatatattgccctatttcttttggagaatatttattacctgcagctgcgaacctttgataaaggatttaaaacctgctaaagaaggcgaaaacccaattaccataagcagtacgaaaagactgttcatggaatttttatggttcatgctcttcaatgtcgttactttagttatcttttccaaggtctcatttccttggaccactgagccctatttgcaaagaataatatggtgaacagaattgattatagttgcaaaaagacgttctataaatgtttactagtagtatttattttctttttttatttccatcttttagtggccaaccgttttgtatatattgatttttcttcgtagtggcctcaaaccgtttgagccacttaatggcaaatgatagcgaactttctcctgcttttaggaatactcttatagacataatgcattgatttccacgaacgttcatggttggtaaacgtaagggaattgtgctatatatatatatatatatatatgataatattgtatannnnnnnnnnnnnnnnnnnnnnnnnnnnnnnnnnnatttcttaaggttgaaacctacctagaacagtttaatagaaataaatattgtccaaatttctttttggttgtagaatgttaattgtgatatttcataaagctatattttcaaattcttctctcgcttcttccactttagcatcatcacttcttatttcattttcttcctttttgttcatttcttctgtttgcttatttacatcatcgtctttttttgctgattctgtgacatgttcgttttcaacgtgttctttttcttcaacctttggttgcttttcgtcttctttcctctcgctttcttgtttaatgtctacattatcagctttgatttcatgctctgcttgtccaaggctttctgtatttacagttgtagtctccgcttcgctaggttctgttttcacaattttgacagattcgtgatcttgaacagattgtacatctgcactaccactatcttcgccctttatggattctgcgttgagggtagaaggctgttcagctgccactttcttttgcgaggcaggcacgtatttctgctcctgcaaggatgtgtcaggttgagatttttgctgttgtgatctcaagttttcttgatacttgatccacgttcttctttttaaaacttcgaaataatcttgtataggaccattagatttcttatccctgaagaccaattcaccatcaccgctaaagtagtcgtcattgtcatctactaaataccaattaccagcttccaaatcgttggcaaacgataacagaaattcaccccaattttcagcaatgacaaatttcgtatcgaagtccctcccaaatgttataatttgagcatatttaccatttggaccaggcgccaagtcaacaccgatatggttaccggcattgtccgttattaaaggaatccaagcaggatgtgcatataccggttgcactgcatttggaggaatagatttttgatctgggatatttggcagtttgaacttgttaccatttagtctttccatagatgaagaagagccagtagatgtaacatgggataaaccttgttgagatcttttgtttaggttctttgcgacgtttctccaggcctgagtcatagctacaacctgatctagtgtcattagttggaagccataaaacaagccagaagtaccggtcatcgattctaaatcttcttggccatcatgaattttgaaagacgcttttactgggttgggaaagctaacttccaagtcttcctctgcgtgagtgatatcgttttgggtgcaaggatcactcaaagttgcatttaaatctggattatgttcactggtccaaaaatcgatgtgtctccaagctaagagggtttcagagacaccatcgtttgactccgtggacgtaaattcatcaatatttatgtcttcattagatggcacgccattttgaaatcccatgctcatttcctcatctacactattcaaatgcatttgagagggatttacctgaccattgttgctgtttaaacgtttacccatgttaaaagtaggcgtttcatcggggttatactctgcataatggtcgtcagtgctgagggagtatacccattctttaacttttcttttgaatagatccattttatactaaaaaattctgccaagttgtcgcctatagaacgaatgtgcgtttattttgtattttctttgcgtattgatagtatagctagtccttgtatattttcaatttttcgataactttagtcgaacacgaaaaaaaataattagcggatttaattttgtacctttattttcaacaggcttgattcttgaatggcgtatttgcaaatatttcaatattgagagaagctaaaatttctaagaatggacttgcgtttgaagattgcgtagcagcgcaaagaattgattaaaatgtaatttactctggaaagaaaacacaaccttttcagttgcggtgcaaaaacattcttttgatctcgaagtaggaaaactgacattagaaaaagaaaaaaaaaacaatctgcgaattatgcatttctttttttcgcttttttattttcttttttctttttttcgacctcnnnnnnnnnnnnnnnnnnnnnnnnnnnnnnnnnnnnnngctttggaagccctatatgtaatctagggtaatgacatatgtcacgtgctttagggcttggtgcctttatttttatgattatgtgacaaggatctaagggggttttccagatacgggaaaaaataaatagtagactatcctaaaaaggaatgtaattaacttatgatgtacaaacggtggtgcaatgcatgttaagccctgcaggtaaatggatcagtgcggagtacgcatcttttgcgatgttcccatgtagattggagcctctctgcttcgttctaactctcctccgttgtcataaaggcctgcgattagtaaggtggaaggtatctgaagttaatgctaggatttcaaatgtatacctttttattctcttgaacaaataacgaaatcctctacaaaaggtttctattgaaagttcccaataagcagcaaattcttcttcctctacttatctgtgatttttttttaaaaaaagttaatcagaggctactacatcattgcgctaaaaaaaagtaacagatttgcgatgtcatacggcggatcggcatcccaagatatagtgacaaaattgattagaaaaatccaaaatacgtctgtgtcttgcaccaggagggatgaaaatctagattcttttaatcaacacttgaaaatgagtcttaaagttgcgcataacacgaagacatttgcaaagcattgccttcatcgacaagtattcaagaatacgtatcggaaaagaaaagcagtggaagatcaaaggaaaaacttgaacacgcaacttaggcaaaaatttgcgtcgccgtcagacaatttgctttcaccatgctctagaaaactgaatgatcacaagtcaaaacttttctcagccaaatcgcaacccaaaacactggagtttgtgcggggcaaacagaatataccacgcaagccgaatgtagacatttaatttaacggatgatgatcataaattggcctatttttttgctgtatgtgttacatattatactatatacgttctccaacaatacaagatgatacggggtaatactccttattcttattctagaagacatacaaatatttatgttttacgcatcgctttctttccctttattttgtattcacaagtatatggcatcttaacattgttactcaattcttaaagataatatctagccttcgctatttatttgccccttccatcgattcttgcatccactacggtatttagcaacaatgcttcattatccaagatgactctatttggagagctagccaagatctttgcaatgtccctggctgtatctaatcttttcaattccacgtagtctcttgatttcttgatggcttcaccaatcagttcggcggatttggcttcaccttgtgccctcactaccataccttgtttttcttgtctggctttatcaactacaaatgcagccctttgagcatcttgttgggcaatttgctttgcttctacagcgttcgtaaactctggcgaaaaagtcatgtacgtaatagaaacatcatccagtaggatattgaatttgcttgcacgacgaaccaaattctcgcgaatcaacctggaaactttttctctttgagtgattaattgtgacgcattaaattgggccactacagcctttaaaacttcattaacaatggaaggcaacactctttcatcgtaatcctgacctaaggttctgtatatggtgggcaattgcaccacatccggtcttgaaagtactctacaggtgatattcaccatttgtaagtctttggtacctgttaaagaagcaacattacgaggttttgctctcacatcataaataattggtgtgtcaagccaagggaaaatgaagtgagtaccttcattaaatatcctagaggaaacaccatgtattctggaataaacaatggctctatgaccaccatctacattgaacagtgcattattaatgaacagtgcaccacctccgagtaaaagcaaacctcccaagcctgcaaatgccccccttggtgaaggcacttgacctctgcctccggtttgctgtaccttggacaattgtttttggaacgcctttgcgtacctttggaactcaccaggtgatctattcatcagcactaaattatattcttttctagcagccgcttgcttttatttcgtgagctactaaaatacaacctcccctgtaaaactcttctgatgtcctttatggtttatgaattgcccttttttgctattatttcccttagatgccaaaatgagcgatacaagaaaagtttgccactctatgtcgttgatagtgattatgcaacacaattacatgcaagctattaaaatatcgactaaacggatacggccacatcgcagtattactcatagcaatagaggaagtagaaagtatttaaatggggccactcaaattgcacactgctttatgtaatctgatttcatttctatacaaagaatatctctcttacccggctgtcaagtatgatcgaagggcccttcataaaagggttctttaaagaacgatcagctgaagctgtgataataaatgctacataaatgcatgcccttaaaactgtataaccatgtctaattatcctttgcatcaagcctgcatggaaaatgagtttttcaaggtacaagagctgctacactccaaaccttccttgttgctacagaaggaccaggatggcagaatccctttacactggtcagtttctttccaagcacatgaaattaccagttttttgctttctaaaatggaaaatgttaacttagatgattatccagatgattctggatggacacctttccatattgcttgttcagtggggaatttggaggtggtaaagtctctttacgacagacctctaaagcctgatctaaataagataaccaatcaaggagttacatgcttgcacttggcagttggtaagaaatggtttgaagtatcccaatttttaattgaaaatggtgcgtccgtaagaattaaagataaatttaatcaaattccattgcatagagctgcgtcggtgggttctttgaaattaattgaactattatgcggtttgggcaaaagcgctgtaaattggcaggataagcagggttggaccccactatttcatgctttggctgaagggcacggtgacgcagctgtattgttggtggaaaagtatggtgcagaatatgatcttgtagataataaaggcgctaaggcagaagatgttgcccttaatgaacaggttaaaaagtttttcctaaataatgtataagatttcaaaactacatattacagaactttacatatcaatattattctcaaaaagcaactcacaagcgtagtagatcccgctgtaacctccatcagctggtatttggtcattttccccgaccgatgcaatcaacagtagtccgttttgtttgatgatcctagccaacgacgggcatatcttcagtacttcatatggaagcgttacacctaacaaattattgttcatagcaaattgaaccattgtatgtatgtttattagttccgtgtttaaatacgacattttttgaggatttacggccagttcctttaaacaattaggagtatcacctacaaatttgcctgtggttgaatctctgagtagatttttcatttgcaacaaaaccggaaaattgggttgtttccagttaaggatcgagcaagcttcccaattgcatgaactgaaaactatttggcgcatactcccacttccgctgtgacgcaaaaaacgttcatgctcgaaaatgattagtaaaagcttatcaatgaattgattgatatttataaatggcgatattttgatgggaattgtgtcaatttccttatctgtaggaaaatatacacgaattaccagctgggctgacccgggaataacttctagtaggcttctgagaggcaccactctcgaagataagtattgtttcaatgttacttcatcgaagcttccatcaattttaccgaagtcataatccactaccttttccaattgttctttcgttaaatcatttaacagaatcttcgtgcctttgaattcaacgtatggttttggcgcagccactatggtttcatcattcagagcgcaaactaatacactaataaaactgccattcaacgatgaagaagtaacaaaattaccgtctttactagaggtcattaaatcacttcctgtagatttccaatacggctcataatttatgattttcagtggatttcccggataaggaaaaataatttggtaatccaaagtgagagatccaatattatttagtcttgtgtcgaataagggtaaattcatggttgcaatactatttattgccaccttcttgaaaaggaatggcattgccgttgttttggcaattatccttgtgccaaatgaaggaaatatctcgaaatccattgaaaaatcgtcgattgaatctacttggaaaattatctctccatcatcatgatcttcactaatttcatcatcatcttcttcatcatttgtttcactgatatccttacaaaagttattaatttcgccagatctaacaggtaaaataacatttcgcggtattatttcaggtaagtttgaggataaagtaattctgcctggtgatgatgacataataatgccgttatcctgagtcaacttgatagactcgagacctggcctcaactttaatttgatgaaaatttttttctccaaaaaattatgaccatatttccttagtggaatgattggcggtggtaaagcaaaatccggaatgctatcttgaatgtctaaatcaaatttgtcatcatttggggttaaatctattgtattaaggcgttgcgtactagactgcgaatttatttcattcaggggtgcagatggcaaatttaatggtctttgtaaaagtgcattcaaaacatcaacgtggctctcccataaggcgtaaaaaagtggcgaatggccgttgtcatcttcaatatccagacgtgcattatgtttcaatagttcagtaataacttcagaatgacctgaacgaacagcgtaaaaaatgggcgtccatttattaaacccatcaatttcgttgggatccgccccataacgtatcaatagttgaattaattgtggatcgccgccaatttttgccactatatgaagagtgcataaacctgttgagttctttttgaaaagcggttgacacaagtgttgtgaacttttgttcttggcattatcagcattttgcttactccgaatttctaaaagtaacttggcggcgtcatgattattaaatttacaagcaacatttaaaggatcgaactggactttagtagagctgattacattcttactataatccagaattggcttttcaatgggtgatgcgttcgcaccaccaatagtcagcagatccctaacaacatctatgtggttgttagtgatagccaaaaccaagggtgtcttagaatcactatcaatgggatcaacgtcctctaaaagattggtgattagcaacgagtgaacaaattccagttttcctagctctgcagcataatgtagcggcacccgcgaatgtatatcttgggcattcagtagtttttgtactgtttctttagataactttgatgttgttaaagcctcatctagaataaataagcgtgatttttctggacaacttgcagcctcgtgaaatacgttttttcgtgaaaatacttgatcatcttcgtcacaatatgacagatcaatatgatcctgattgcttttatagaaaatatgcagagagttatcgtccaaaggactagccaccagtaataaaaacagcgtcgttaagcactccttcaacaaagaaaagacatttttatgaaaagattctgaggaattttgtagcagatatgtgaatatcttggtttctctgaagtttcttagtagtgcatgctttctttgaacatctttcaccgtggctatattcaaaatttccttataccagttttcgatttccatctccatgtccaaggaggaggaagatgcttgaaaaagatgttcaagttggttttccgaaatctttgatgttgttaattcataattattgtgtaatatgttattattattgttgttgttgttgttgttattattattgttattattattattgtgtttattattgttgctggtattattgtcgtcatcatcgtcattagtaaacgtactggattgtatgtctgcccttctattgttgttgtcaatatcattcagctctaagagaatatgtaaagtttcatcgtttaattttagtggcccatctctggtaaaaattggttgaatggaaacaacagtagcaaggtaaaaatctttatcgtgagattgagatctcttgtcccatttcttcagagcttttgaaaatcccgttttatttaactcaacatactgctccaaatttctaagatccttttgaaactttttgaaagccgcatataagtttttaaatgaggtagcttggtttgagtttagcttaccatttatcttataatctttatattttgagtgtaatatattgaattttattcttaaatcggactctctcgccaaataataaccatttactttttccagctccctctctagtttaaaaaaaaaggcagctttattttcttgcagtctctgatgtataattttttcgtcgatgtcatctaatgttaaatgcaaatctaaatctgaactagcctttagcgtgggaatggccaattgtttgataagtttctttagagccttataatcaataaaatggctgttgtactccgccagttccaactgcctggcttccaaatacttgccgaatttcattgcacgtttatctatctatgttgcctccaaagggttattctctcaaaaagctcaatcactgtggaaccgaaaaataatgttatgaagattttttgagcagtatgtcttgtcaaaagctcaactagtgcagctgatgttgcttaaaaaaataaaaaccaaatttttctactttgctcttgtacgttgcacaaagaagattatgtaacaaacttgaagggactctcaaaaacttgctataaattgtacaaaagcctcaatatcacctagtagtggttctatacctgtctcgagccatcgccaaatagttgataaatttgattaatttctgcccttattcgcacgtgccataacacctgtacctctcacgctaaagacctttataatcaaggaaacttgttgctgcagaggaaataggaggtaatgaattgtgataaggcacatcacatcaatttttcttgcattcttgcatagaaagataggctgatgcaattagcgcgtttcaatcgcgtgccaaagacgtatatactaagcaatataaccgaattgattaagtagttggttaattgtatattttgtgataaagatggttaactgacttaggcggacataatagtagaaaatctatataatttttcccatgcagttgttattacaaaatgcaattcttgagatagcacaagcaagaataatagggcacggtacgttcattcacgtagcgttagctagtgctgccacaaggtaaacgtacgattatattcatttttgaaacggaagttctttgtaaccctcatgctcgtttgatagtcacttaactacaagatattctcgttcagtgattgcttgcttataaatcaggaaacttcatttttattccttacattttcgaaaagcccgcaaggttttcttcgccacgctcaagcattcatcgttgaaaagcaaaactgtgcacactgtaccttaggcgactcttctccgaacaagctcatggctcatttttaaaatcacaagcttcgtataattgccaagacataatctaattgagaaggtcagacggcaaaacaaatgaccgaaatcttcgtttattggttcgcctgcgttgccaactggtacattttcccagagtaccagcaaaggaaggcatccttgatgcctactctgatactgtggaggatttaaactgaaaatgatagtctgcgcggcaaatctttctatttctactaaagttggatcctccggccgatataacgtattctttttatccaataatgtcaattttaaatgctcgattactaatcgttactaaaatagcggacgcgcttatgcgtcttcgacggatagttttcagatcatccctctcagaaagcaatgcaggaaccgcctgtaaaactatcttttgctggcactcacacattatggtattgatgccacctgaaaatacggaaattaaccattccttgtacggagatctaagagcaactattattgaattgttgccgttaaagtttcatttcagttccgtgtgtggtcaagtacaagactactgatgaaatatgttgtacacacacggaaatatatatatatatatatatataacaatattgtgggttgaggtggagacttgatttttcttatacagtatattcttgttcattttttaccattttcaacaaaccacacaaagactttattcattatgctagccgaaaaaacccgttccataatcaaagcaaccgttcctgttttggaacagcagggcactgtcatcacgcgtacattctacaaaaatatgcttactgaacacaccgaattacttaatatttttaacagaactaatcaaaaggttggcgcacaaccaaatgccttggccactactgttttggcagcggctaagaacattgacgatttgtctgtgcttatggaccatgtcaagcaaattggccacaagcatcgtgccttgcaaattaaacctgagcattatccaatcgttggtgagtacttgttaaaagcaatcaaggaagttttaggcgatgctgcgactccagagataattaatgcatggggcgaggcttaccaagcaattgctgacatcttcatcactgttgaaaaaaaaatgtacgaagaagctttatggccaggttggaaaccatttgacattactgccaaagagtacgttgcttcagatattgttgaatttactgttaagccaaagttcggttctggtattgaattggaaagcttgccaatcactccaggtcagtatattacggtaaacactcacccaattagacaggaaaaccaatacgacgctttaagacactactctctttgttctgcttcaactaaaaatggtttacgatttgcagtaaagatggaagctgccagagaaaattttcctgcaggattagtctctgaatatttacacaaggacgctaaagttggtgatgaaattaagcttagtgctccggctggtgatttcgcaataaataaagagttgatacaccaaaacgaagttccattggtgttactatcgtctggtgttggtgttacaccacttttagctatgttagaagaacaagtcaaatgcaacccaaataggccaatttactggattcaatcttcctatgatgaaaagactcaagcattcaaaaaacatgtagatgaactattagctgaatgtgcgaatgtcgacaaaataattgttcatactgatactgaaccactgattaatgctgcattcttgaaggaaaagtcacctgcgcatgccgatgtctacacttgcggctctttagcttttatgcaagctatgattggtcatctaaaagaactagagcatcgtgatgatatgattcactatgaaccatttggtccaaagatgtcaaccgtgcaagtttaggcgttaagcctcggaaacttcaattttattactgattcatttgataatttcacttgttcgatttcacagtttgagaagttatattacgaaataagaaaaatttttaaaacatgagaccattgctaatcttttgttgttatactgtgttagaaatcctcgtgaaatccttgtgaaatcctatgtggaatatttagatagtaagtaaagattgtgtatgtatttataagatgaataagcgccaggtgctaaacagagttcacttcacgttaacgccagtccaatttttgattgcattccctgttttttctacatctttgttcaaccattttttggcatcatagtagtattgcacagacgcggtacttaatctctttgtttctttccaaacacgatcttgtctttcggtaaagtgtggaaaggtgttcatttctagattatggatgagacccatggtgttcctgaaggttgttggcattgcatacgcaaaacaacaagaccccagtataatgggcatggttgcacgaagaagccatgttcttcttcttgccaaaacggaacctgtcatggaagcaaccaaaatggacaacaaccccggtattaggcgctcgtttggatcggtatgtaaactagcaattgttgatgtaaagctctcttcacgggcataatatctgcctgcgatatcatctattttatttgtcaccttgtcccatttagcggaaaattgttttcttctttcgttgaaaaacctcttcaagtagtcaggatcacgtactgaaataccgtctaccagctcattttctccaatatatttcataaccctttgcgaaagaacaccttgcttggcttccttctcattaacagtagcctctttggcctccgaagaaattactatagcgttttctggtggaacaatcttctcctcaacgggatctagctgacggtaaaaatcttttgtcattgtttccgtgctatatcaaatacagtagttatttttgtatatccttgagcgctatagtcggttgcaaacgcaacttcttttcaagtttagtattatagggcagtagcttattcgcctttccattagattaaaaataaaagaagtaacggttacccgcgctttagtatgtaaagggaactcaccaatgatttgcaatgaatcccctcatcaatcatttatgctagttgaatatttactaacagtaacaataatagcagtgcattagaggctttattgcgtcataaaataaatatcagttcaattaatgtataaaagaaaatgcttatatatgtattgattaataaccttctcaatgatgggaggggccttatgtaaaatcacaatccccttccccgtttgtcgtactatgattaaatgcgaaaacaaaatgcaaagaacataaatgcagggaaccaagtacaaattcccttacatgattgaagagaacatcaaatacgttacttcatcatcatccatcatctcttgtaaactcttacccttcgtcatagctgctctctgttctgtacccataacagacgccttagttgtgtctacgccgttgatgttgtctaagctatgtgcaggaaccgtatagcctctcctcatgtatgcggtcggtaccacagcagcgcccaccagccctaacataatatatctaaactttggagttctcacaactctttgtgcctctgagtatattcctgaatctaacttcatttcagtaaactttgtttgaattttatgcgctaaatatttgtattgattgtatttattgattctgatccttcagtaacacacattccaaactatcctggataatgtgaaagagatttggcagttcaatttatatgaagaagaccctcacgtcgcgaagcatttttaacagtgttatcccagtatcccgtaattcttctcttcatccaatgctggccattactccatttattggggtgatgtaggcttcttatcccttttaaagggtaccttattgatctcccttttcggtgcggctgatgaaatctatagagcaaaccgaagtaaaacaaaattacgaaaagaaatataacattatatctttatcaaaatgtatgtatggaggagtaacagctgaaaacccccgttgtgagtggtttatgattgttttcacgcttattttgtcttctatatctttgctgattttacttgtattaatccggttcatccgaaaacttttttgaagatcgagccaaatttactttttttcttcttttcagaccttttaaattgatggtcgtttgttgaggatgaggaactgtcctttttgctgttgcctgatttggtgctttcggtagttttcgtccttgaaacgtggttgtggtgatggtggtggtgatgcgcttttctctgtcctgaagaagatgaagtggaggatgttctgggtgatagccctgcggattttgtttttctcattggatgtgaagtgaacttcattttcggatcctcattgtcccattttagtgctgtcttgatatgaggcgtagaggcagtttcgtggttgtaaatgtcatcaaccatggactttactttataaatgccgttattgttgaattgtattcttgaactccgctttgagctgcgcctcgaatttctcgattctataggagttagctttcggccagaactgtcgtacttcataagagtgttatcatccaatagtacttgtctcgacggttttggtctaacatatcccatcttatcgaagaattccatttcttcctttttttcaggtgagattgggaagtactcatttacagaggttactgactcatcactatcgctttcttcatcatccgaatcaaccactttatgttttgtgaaagggttttccaaagttctcctgattaatgcacttagccattgcaatcgttccttttttctcacttccgttttcaaatcatcgctgttgtcctgttcatctttatccactctaggttttattaaaagctcaggcttgatgaattcgaatgggacaacaaatgctggcattgcaaagtgtttcattaaaaaaaatggtagtttcacttttccatttctaaacttgatttgaatgttggcactaacggtgctgattacttgcaaacttggcctatacagagaggtcgcagatattatggctgatcttgttgaattttcttttaccatctcaatactaatcctaactattttagttgccaatcttctcgcgtagtaatttaaaatatcgctacaagtttgcttagcctcattatgaatagcttctattcttattcccgttgataaaggactagagagatccgggcctataaggctatgtgacgcggtagtcatgctttcactagtattgctagtcatcctttctaagcggtgccttcttttctccttatatgctagagtatcaatctttgcttcaaactcaggaattgtagtaattatgactaaatgatcaccatttcttgtcaaattttcaacataccagtccacagatgaccaagtatatctcctacctgatatataacacgaaacaactcttaaatctacatcgtcatctttgtctttgcaattgagcttttcttttgtattggaaatataattttcatagtctggatgatcaattgtcattgaaattgcattgtgaacaattgtaggccttgatggataaattgctgctaaagggtccgtcacgttgcttgaatccgtttttgactctgttgtgttcaaatagactggaacttgctcaccaaaatcaaattgatctattttagtcttgttcgatcttcctttacttatataaaattcctctaatttggctaattcttcgtctgtcatcccggcaaacgacttggaccttttctttgagctctccatattttcgctttcggataaatctaccattgacttggtctcaattctatcttcaacttcattaagattggcaaatgcagcttgcgtatagcctttccttgatccagaatttttttgagtgtttctttcggtcattttggtcatttttctttccagctcaaaatccaaatcaccaatatcaatatcatcaatagggccctgttcatcagcagcttttcgagatttttttagcacggatacttttggagggggaggcaacctcactgaagtccttcttcttgacctgaacattggagactcacttctacttctttcaacgctgggcgatctcaaatagcttttggagggatcatgtgctgcaggagaaaatacctgagtatagaagtgaggaactccagatgttgtagacgttggagttcctagttgtagtggcgaagaagcttcttcgtcttcgggtgagtccaagctttcgtcagtggcaaggtcattagagccatggctaccggtcaaagtatttttgtaaacaggattaaattgtggaggtatatgtaaaaaatgattattcaagccaacatggtgactgtcatttttaataatggtagcttggtcatcaattaaggaaggtgccagatcatcaaacgagatatgcttagtaaatgtctttgcagatgacatcttctattatttttattagatattagcagtttgccagggattacagcttctcccttatgtacagtgcgacaatattctttttttcaatgtgtctttttattcattcttctgaacagtttcgcttcgttaagggtccttctggctttctagaggcatgctcacctaaaatccccctagaaaagcgggctctttacccggcgaataataataaccgcggctactaattttgcaccattgaatattaacctcaaaaggcttagttggcaattatattctccttctattaatacttaatgtttacaatgtccttataggtgtttaaatatatttttatatactttgtacatattgacttcccagtgcgtaacaacgtcttccaatgactattttttttgttcgagagtatatagttttttttttaaagctagcagttcgtccttgagggaatctctattttctttcgacatatacagttccgctttcagattgttgattttcattctgtggaacgcatcaaaatttccatgagtgatggcgccacgctgttcctgcttgtcatcctgttcagcttgttcagttttaattctatcaatctccttctgtaaatcgtcgttgtttttacgatatttttcgagctcggattgtgataggtgaatagccttctttgttaggtccatagacttcgagcttccatcagagagttttcttagcgcatccaacttgttgttattgtcgagtaaattagcccgcaaagaatctctttcatcattaagcttctgagtttcaaggtgcaatttctctttagcacgcacggtttcgtgcatttcatttattactttttctattttgttcagcgaatctttctcatatatttgattatctttctcacttgaaggtggccgtgcactggtaggatagctttttaataatttacccagatagcaggacgattcgttcaaataggtatgaagttcgggggttattttttgcatattatttacaagtatttcgttctggcgcttcaaaacatcacatttattctcaagatcgatgatatcccttttaatagtgacatgttcggagcatgttttaagtccattattttgaatcgtaatttggtcacagagtttacttgcctgagataatttgaccatcaataaattttttaaatcattaattctagattctaaaaaggttttctgaatttctagatttttaagccgtgctgtttgaaaatttgaatcttttgaagcttcttttattaccatgagtctctggacttccttttctaattgtgaaatatgtctagcagtttcaagttccttttgttgagcttcgagacgtaatgtttgtaggttcaggtttaaatcatcaaaaagatttttgggaattcctttttgacatgatgtgtccttatatgaagaagagccatactcttctgaatccactgttagtcctcgtagaacagggaaattttttttagatactttgataccagttcccggactttccttattgatgcttgaatcaactttggaagattggggtttcttttcctccctatctgattttcgttcaaatgccttatcatccaaagcgctggagtaacttccagccccttcatcaatatcattataactcaaaactttgctatcaggcaatcttggtgtaagaatgtttattatctcttgattttcactttcggtagacttagagggtgtaaagcccccggaaagactattagaaaaactttctcctgcatgtagtgattcacacattattcctgggcatagctcattcaaagatgataaatctaaggtatacagtaaagttccttcgccttggtcagtttctgaagtttgtagatcgtgaatatttgggctggcatagtcagttttgtcgccacccatgataagaagcttctcattcttcattaaggttaaagaatgtccagagcgttcttgaggtatgccctccttcatacggggaagcttataccattttagcgataataagtttaaaaaatagacatcgttggaatatgcgttatgggtatccttaccgcctaacacacacattaaatgtttatacaccacactagcatgctcttgtattggcggaggcttttctcctgtggttttaactttagaccactcactttgtgctggatcgtagcggtatgtatcattgcttattgtcttgggagtttccccgccgaatacccataatttgttgtcatatgccaccattgtatgatttgttaaaggaggaggcaggtcgccgacaggctctaaaaattcccaatgagaattcggcctacggaatgatgataaatcaaagacgaccagatcgttaaaataagtttcatctacttgtccgccaaaaagatatagtttagtttgcatagggttgctagcaattatagaaattttatggccgtacctgcccaacggcctacggnnnnnnnnnnnnnnnnnnnnnnnnnnnnnnnnnnnnnnnnnnnnnnnnnnnnntccacttataagaattaatattgaaaagataaagatcatcatccaacagtccgttcttattcagcttgtgtgtgtcgccaccaaacacaacataggcattaccgcatatagtagaggcatgtcccactcttgggggaggtgtattttgatcaatatcgattctcttggaagtaaagctcgtaccatccgcgttagcggctatttgccagacatccccatataccgattgatcgtgaagtccaccggtcacaaaaatcctgttatcattcgtaacaataaatgaggaagagtgtcgataacggggaaacggagagttttttagtttgaccctattccaaatatacttccctgtattcttactctctggagaccagggaagagcagtcgacgcgcctgatatgcctctatgctggtttggaggtagcgtaggtgttactattcgcgtattgtttcgattatccataaaaactattggtctgggtacactttgcgctgaaatcagagaaggtcccgtgtccgtaggtaccttatttgtcagcttgaaaggtaccatagctacttaaggggttgcctgcctcatccaaatcattttttttttttgttacaacctatgctaaaattcacgtgtacgcatttcaaaattgaaaaaaaaaagagcaagcaacaccaaaaccaaacttcataataaattagtatcccaaaagaccctttcacaaggtaattacttccttcgagactaattcgggttttgcgaagcttttttttttttcttcacagtttctcccaagagaagaaaaaattcacaagcgtgtcatttcgtgcagcttacatcagcacaatccatgcacaaaaaaggtgtagtaagttttaaacgagagagatgggcatgacagtaggtagggcatgcatctgcaggagtgaagctgcgatactcctcagcgcagagaacacataagggcacatattcatgattttgatattcttagctatctgtaaacatatatcaacgtatgtagtagttacaagaggtacaattgtagaaactgcctatatcaatcaagtatgtctttgtgaatttcgtccttgacgaaaatgtgcctgtttccgaccagttccccgttgttggatgagaataactcgcttgcggaatttccatctgcatttttctttaaagtcacgtcaccgctactaatgtttctcattaactgaatgaacttcgactcagatagttttgattcgacagaggaggaaagagtagaagaggaggatgcagacgaaggcggtggagtacagcattttactatatctgtggcaatcctttgcagttccgactgatcttggtcgaaccatttctcgtcccgacgtgttatgggctcgtaccgctctttttgaatttctctctccaaaacttggaactccgcgtcgaattgaaacgcatccgttgggttgtcccggtttccttggcgttgctgtcgaagcgtcttttgaggtgggtaagtgcaacttgtcttccttatcatacaattcttaaaaggtaagtgttgtctgcttgaattcaggcgctgctgtgactcgtaattggaatacaaccttttatattctgagctaaactctagtgaatcgtcaatcttcatagacgagaactgcggaacccaatcactggaatctacagtgttgtttggagtaatgaaggttaatggagagggttgattttgataccttacattgtcaatgccgtcaaaattactaccattatgcaaaaagtgtttttccacatgcgagtcttcagtggcatagtgtgctgttaattccgtatgggccagcttggtgcgttttgacggtattaaggaatcattctgtatgcgatgcccttgttggataatcttttctatcgggcttgtatggcagacactgggcatggtattctagtttggtctttataatttttcacctgtttctttttgaaacaaaaccaaagtatgcggcgtcaaccttgactatattctcttaaatatatatctgccgttctatcagaggtttgaacattgccaatgccttaaagaaatatttagtcatcccatctccgattatcggcactagtttccatttttccagcggaaagataaaaagaaacggaaagaaaaaaggccgacaaataaaccaaacggtattcgtagaccgatgacaatacgactacaattaaggtagcgcgcctcactatgatgtggatcagcctcacattcagagcaatttgtagtacagcaaagttgccgatgtcgtcttcgtgaaccattgtcaacgcagattaagcacaccctaaaacttgaataatgcaaattccatagcttagtttaatcaaggcgccattattcctcagttgaaaagtatatctaatggttaggattagaaatatgttcattgctcattgttatgtgtatcatatcgtacaaaaattatataaagaaataataatgaaaaagagtaaaacaaagacaaatagacaaaaatagaggatagaaaaagaaaaacaacagatacataaataagtcttatgacaaaaaaacgattgtataaaaattaaagtgcatgccatttttacctccttttgcttaacttaaacttttcattgcaatcattcatttgttttcagcggctaaagcggctacctcagctctcaactttaatctaccggacaggatgtcaccaatcttgttgtattcagcccagtgaacttcaaaaccctttcttaattcaacgttggtttcgttttcccaaaggttagcaattggcttgaaggaaacgtgagaaccattaacacagataacagcagcagagtcatcttcgtgctcaacagttggtaccttttcaccgtgagtatcgaacttgaatctcaaaaccttagcgtcagtgtttggagaagcttcatttttcttgttccattgttcgataaacttgatacatttgacagcaaatctggaagcggtgacacggtctttagaagatggaacaccaccttgttgaacatggcctgggatagcagttctaacaccaaacttacccttgcttgcttcagagatgatgtcagccaacaattgagtgctatatacgctagaagcttgttcgtttctaaccaatagcttaccgtttctgttttcacctttgtcgtgacgaaagttctcttttaatagagttatatcttctctgatagaagctaagtcgatcttcttttctggagtgtacactgaaacagcaccagtgattaaaccagtgaaagaagcgatgtaaccagagtgaccaccttggacttcacagacgaagactcttcttcttgtcgcagaagcactctgtttgatgtcatcagtgtaattgactaatgcgttcaaacaggtatcaacaccaagtgagtattcagtacctggaacgttgttagaaacagtggctggaatcaaacacattggaatgttaaagattgggtgttgggttctaccgtcacgcaattgcttcaaggacctgaaaccttcaaaaccaccaagaataatcaaaccgtctagcttgttcttttggaagtagtaagcaatggtacccaaatcttctgaagcaacagatctgttcgtaccgatttcggaaccacccaagttatgccagttttcgacatcaatccatgatagttccttcacttcaccggtttgaatcaatccactgaaaccattcatgatagcgtatggtttatggccgtgagacaaacagtatagagttgcggcacgggtggcagcgttcaaagcagcagatggggcaccaacatggacaataccaatgtttagtctgtcagatactggcaataattcggaaccatcatctttaacggtagtggataagaagttttcgtaaagttcaataaattctgtgtctcttaaagaaattgccttatcgaaatctttgttttcaatggcagtggcaacagatttagtcaacttcacagattcaaccaatggcattctaattatcttgttttctaaaataccaattaatggagaaggagtttcaggggtaaattccagaacggccttaacagcatcgacaccttgtagagtagctaaccatctgtcatgagcaacagctgtaccacctctttgaacgtgacctagaatggttaccttggtgtctagacccaattcaatcaaagcatctttgacgtcattggcagtaacagggtttaattgatcatctaaagcaccttcagcgacaataattgtgttatttcttctacccttacttctgtgtctttggcacacttccttcaattcgtcctgccattttccgtgaggaacagctctttctggaataaaaatgtaatcggcaccggtagcaataccagccatcaaggccaaccaaccacaatgtctacccataacttcaacaacaaaggcacgggagtgggatttagcggtggcatcaatgtagtcaaccatttcacagattctttccaaagcagaataagcaccaatggtagagtcagtaccagacatatcattatcgatggaaccgacaagaccaacaatggacaaattcttgtatggggcgacttcttctttagtgaatctaccttctgcaaccaattcatcaaccaaagatggccattcgtgtctgaaaagatcagcaccggttaaagaaccatcaccaccacaaacaaccaaagcgtcaataccttgcgaaattaaattgcctgcagcttgtctacgaccctcacgctttctgaattccatagaacgagcagtaccaatcaaagtaccaccttcacttaaccaacctctgacatcttcccaagccattttctttaaatatttaccgcctcttagtaaaccttcgtaaccttcgtaaacagcaaaaacatcacagccgaaatgtatacctgtacgaacaacggcacgaacagcggcattcatacctggagaatcaccaccagaagtcatgacagcaatcttcttcttcttttgagaagagcccaatgtttgtcttagtaagtcagaagcatcggaagaagctctagagatgatttcgtcttcggaggtagcttctaagaaagcatctttggaagttggagcggaatcggttgcattagctaagcctgagaaggtgatgttgttgcccattggatctttcaaaaacactaaggtatcggacaatttttcggcttgttttgggaatttctcgacaatcttgttcaaatcagtagagaaataagtgattgtggcggtttcgttggtgtcgaaagtttcatcgattggagcagacatcactaaacgaatctttaatagagcaccttgactttgagccttgttagtagcttcttgttgtggtatacggaacccagaagcatcaacctcactcaacttgaaagattctaaccaaacttctctcaaggaatcttgggaagtccctgaagatagtaagctattttcaccatgtttgaatttgttgaaatctttcacagttgcaaatcctagagtgtgataaaagtgaatggtcttcttgaataaagcttcatcatttgtgatgatagatctgaatgcaacaccgtagcatgaatcttgagattgcatctttgatatgattttgtttcagattttttatataaaagctttcccaaatagtgctaaagtgaacttagattttttggtacctgtttcgaaattaaaaatagaaaaatttctctccctatattgttattcttacttcaaatttgtttatcgtttatttactaggcgagacttgagtagacgacaatccaaatagaattaacagattttattggtagaaagcaataatattctttagatggttgagaataaagaagtaaaaaaaccagtaaagagaaaaagaaaaggaagaaaattaaagaaaaaggatgattacacaagaagataataaaaaaactcctttattaagagcggaagaatttaataatgaagatgggaataagcaaaacaaaaacaaagaagggaaaaaaaataaaaaatcgtatttatttatttaaaaaatcatgttgatgacgacaatggaaaaaaaaaaccgatttcactttctcatccttatatttttcaaaggttgatgcaagtcgatctcaaatcggataacgctgccaactgggaaattccgcaattccgcaagaaaaaaaaaaatgtgaaaacgtgattgcattttttacaggtcctaaaggatttagcccacatatcaagagggtggcagtaattgcactgattaagcattcgtcagcattaggcgaatgtgtgcatgaatattgccagtgtgctcgatattagagagtacattgaagaatattgtaccggattatgtacaataactttgttaatgagatattaattttcttttttactagccgctatcccatgcacgatgctaaatttcaagaagaaactgagatttaaaaaattagtggaagctgataaaacggactataatggtgtatggattgaggaatctcgacatgtttttccatcgttttcaacgatgactgtaacccgtagattgaaccaggcatgccaaagttagttagatcagggtaaaaattatagatgaggttatatgtatggtacgtaaaatttacatgtttggatagtatcataaaatatagaaaggtggaagggattacctaaaaatcagagtttataatatgcaaggacggcctgttgagaacaaaaaactgtagtatctatcgctcactatatatctattaagttaggattttcttgctgatgctgctgttgttgctgttgttgattgatggggacaaacgcagtgggaaccataacataccctgtttgctgaccctgcatcatttgtggttgctgctgcgcaccagtagaggcatactgaagttgaccggccacgggattcgtcatgtatgtgcccattggtgatgtcaccacgttttgagcctgaaatggattacctgtttgactatgagcaagaatcggggtggtttgtgcttgttggagggtaaaaggatttggggagttttggaaattttgttgttgctgttctctggcaatattttctagcgaaaatgggttgttagaccccgtttttgttggatctaaagtgccggtcataattgcattgttctcggtggtcgtgtatccgccgaaccctgagccggtgaaatttggggtgtattgaaggttagaagcatacatcccagtttgttgattattcaaatttggagtaatctgtatctcacttggttgtggcattgtagacgcagatgtcaactgtaaagcctgttgctgttgttgcggtatcaagaaggggttagcagttggttgagggacttgagcggtcatttgtggctgggttggttcgaatgaaaaggtgtcattatttaaatcttgctgttgtgatccaaatgggttgtaagcatcttgtgggaccgtgggggaaatgagcaactgttggttttgtaattgttgctccagcagtcttttttgttcccttatctgttccagtttcttctgcgctatagacttattcttgtcattgctgttgttattgtgactactggtagagctaatggccgtagatggttttctatcttgctgcggttcagaaggttcacctctttgtctttttgtttcctctctcaaatgctcctcaagggagttaattaactttgtagtaatatgtttgataacggggattttcaaaccgacagcttttcctatttttaggtatctaacaacatattctgtcatatccacgaaatccttatagagatccagtgttctttttgcgtgctcaatggacaattcgaagaatgattctaaaagtgtaatgacaccttcattaagagcattgtacagacctagtaaatcttgtactaacaattggaatgcatacaataacaaatggttttctaaatctgaaacagagtatttattccttatcaaggcattaatttgaatttccaatgattcaacatgatctagctcttcatccattgaaagctggttcttactgcccagctttagcgaggagtaattgtctcgtaggtgatccatacctagcctgccatactcttcacaacgtgtttttaggtattcgtcgtatctctgcaaagccctcatatcattggaagaccacttagtagtatgcgaaatctttctcaattggaaaacatccaaattatgggaatagtgccttagcgtgacatctttttcgccttgttgtatcatcagatgcaacacaatcaatgccttataaacaatggtccaggctgtatcagacaaccttatatccaatgcgtgggtaatctcttgcaatcctcttgcgctcgaagtgcccgagagaatagggtccacatatttttgctttggaggggccatctttattttggtcgcccctttaaccaacttagtatataatgaagacattgtttcacaaacacgcctctatatctattataggggtagccgagacagtcgcgcttgtatgcttgatattgttactctcgtagatgttagcaagcgtagcaaattggtactcctgctacagatttattttttctccttctaaaattataactcaagcaagaagccctaataacaagttaaccagactaataagtcgactttttcctcgaatgtagaaaagaaacttttctacgcagctgcaaacttaatctatccctccaccaaagcaaaatgaaaacaaagccatactgggaaaaatctgaaaaaaaaaatggtaggagtaaaagaaaagaaaaaataaaggttaccctgcagtttggatagtcgggtaacatttggcccttttcctccttgattggatattattaccccgattacccctcatcttgggagtgccccgcttttatttctcccgccaatcggctattaacggctttacgtcattccgtgggcgggtcaagcgagccgctccctggtttggtcacgcaaaaccgaaaggctcaaacaaaactaaggccatcatatatatatatgcggctgcgtgcgtgtattctcccggataatatggtgcgttgcaattggagtattggagaaaattttcttttccctttcattacggcggaaatacttcatataaaaaaaaagaatacaatcagtctttaagactatacgcataagcattcaagacacatagaaacacaaacctatatttttaatgtcagcatcagcttttaattttgcctttagaagattttggaatagtgaaacaggccctaaaacagtacacttctgggccccaactttgaagtgggggctggtcttcgcagggctaaatgatattaagaggcctgttgagaaggtatcaggagcacaaaatttatctttattagcgacggcactgatttggacgcgttggtcgtttgtcatcaagcccaagaactatctgttagcttccgtcaattttttcctgggttgcactgcaggctaccatctaacaagaattgctaactttaggatacggaacggtgattcttttaaacaggttattcactacataataaaaggggagactcctgcagccgtcgcagcaaagcaaactgcatccacatcgatgaacaaaggtgtgatcggtactaatccgccaataacgcactgattacgtaaacgataatatgttcctgaactcgcatttttttaatgattttttatgacctcttatatattctttcattatataacctctatattacatcaaaagatggaaaaatataaaaaaattaaaaaaaaaaaaaagaaattttttccaaaagagtatatttatatgtatgtatacatgtagggaaaataagaaactttattaatagtaaaaaagcatatatactttattattaactcttttgtttttctcgagaagcttaattttgggtcaattcaacgacctttttagcagcaggatctaattcatcaaacgaataaatcttcacgcctgacttattgataatgtcgcggccttcttctactttggtaccttgcaaacgtgccacaatggggaccctaacttctagttctctggcggcttctaccagccccagggcaacatagtcacatcttacgataccgccgaaaatattgacgaaaattgcatctacgttcttattggataagatcaattcgaaaccttgtttgatggtctcaggggtggcaccaccaccacaatccaaaaagttcgcaggatcgcctccatttaatttgatgacatccatagtagccatagccaaaccagcaccattgactaaacatccaatgttacccttcaacttaacaaaattcaaatcatacttctttgccttaacttcatcaggatcttcttgtgataagtccctccaggaatatatcttttcctgtctgaatgatgcgttatcatcaaacccaaatttggcgtctgtacacatgattttgtgggttggatcatgttcaatttcactcaaagggttaatctccacttgtgtagcatccctttccatgaatattttatacaaattggaaacagcttttgctgcctcgtcttgtgcatcgggactgaaaccgagactcttggcaacatccttggccatttgtgggctcaatccctttgaagtttcaattgaaaatttctttatagcatctggggttctctcagccacctcttcaatattcataccaccttgactggacgcaatgatcatcggtttcttggtttgtctgtccattagaatagataaataagcttcatgctttgtatctactcttttcactatatatacagcagatactggcttccccgctattcccgtctgtttagtaatcaggttatgattgagcatttcttttgcaacatcctctgcctgctgaggactttcgatcatgtgaacaccgcttttgtaaccggtgtcgaagtgacctttacctctacctccggtcaatgcctgcgccttgatgaccagtttgttagtgtttaatttcttggctgcttcgaaagcctcttcgggagtgaacgctggaaatccttctggagtaccaataccgtattccctcaataactgagctgacctgtattcatgaattgacaagtgtctccttgcttgtaaagcagcttgcgcgtttagcctgcttaattgcccacactttgaaattagggataaggattttcttgagtacattttgttcagttgcaatgcttcagtatttttttcgattgtattgactcaatccttattaatcctaactacctaaaagtcagttacaaaaaaactggactatcgctctatagtcactgttatttttcgagagaaaacgtcaaagtgctgataaggaaaacgtcgatcttatataaaacctcaaagatgttgactacgcggcaattgaaaggccaaccaacttttagaatactcactccgccgctgcggggaaaagccgagaattcccgatgaacacataatcgataccagttggagcatttttctctgtaccaagacataaaaagagttttttttagtatctacctggctttggtgttccattcaaggtagagaagtcctcatacagttggagagatgaatgtatctgtgtatatgtatgtatatattaatatggctacgatgtcgtctaataccccttcttcttttgtttggtgatgtgtgcacgtaacactttttgcttgtctcgtagtgacattttttgtttacctctaacagatctcttgtgaatagacataacaaagttcttccttctttctttttctctgttggtagtagaacgcatgttgtcacgcttaccgcgtctactaccaaatttgtctctaccttcacgaccttccaacaccttttgtaatctttcctcacgagactgtttgtatttgatagggcctgttagtgtacttgcatcaactaactcttcacgcttgtcttgtttgtggatacccattattttagcaacgctttcctcattacgcaattcttgtagtttagcgaaatctgccggagttaaaatacgtgtagaagcaatttcacggaaggcagcttcgggatctatatctgcatcttcttgctcatccttcacttctttttcatcgtcatcatcgcttagttccaaatcggaatctgattccttgcccttagcattgtctttttcatcgtcactatcttccatatcaacgtcatattctttatcactatccatggtgacccactcaccgtcgacatcgtcttcttcgctatcgacatctacttcccagttggcatcagcgtcttcattttcactctcttcaccatgttctttcttccatttggctaacagttcgataccagcaatcccttgaacactgttgtcggcaccaaattgcggtctttttgaatctttacctcctttcttggcttcttgtacttccatggcggcattcttaccacgatccttcttctttagcatttctggtgccacgtctctatacaacgctatcaatgacttggcagccatattgacacctttagctttagaccccttatattctaccagatcctgtagtagaatctcatcgatagccaaaggtgcacgagagcatatttctctaatggtattaatgcctgcagcagcgacttcattggcaacaccgtctgatacaaactcgtctgcaatctttctcaccatgacatttataacttcaggagggacaagatcatgacatgcttgggcacatgcggacataattcttgtaacatctctttgtttcggagttaagtactttaaaaaaaaagtataaattcctaaaacaattaacttatgggtaccaatcaaccttgataacagctgcatcaaagatattttttgttccatgtcaaatttgtttttcgttttgcctgaaagatgttccttaaacaatttttcggcaaatccttgtggatctctcaaaaggtggatagcactgaagtttaaatacccttgaggagcacccggtccgttcttcttcttcttcttcacagtttttatggcattctccagcttcttaccacgtctacccgtttttttattgacttgcatcttatgccttaatgcatctaaatcaaacccatcctcatcctcggaattttcttcaaaattttcttcacgttctctgtcagcatccaaaaaaaacatcacaccagacatgacaatcttaacatcctgatgtaatgctgcttgggtcataatttctactgttcttgaatcatcccaaataccacgtctccaaagttctctggttaattttgtggcccagattccctgggaatctggttgatctaacaaattaaagcaaacggcctgcgtagatttgttcaatttttgatttttaccattagtattacaactttttaataaagaaattaaatttgtataaatgattttcctcaattccttggcgtgtgaattaacgccgagtgaattaccatgggaagagtaagcaaccaataaaggaaataagctttgaattaattcctcagcagtaatgacgtccttattccttaacatcgtcaaacaacttaagattttttctttcaattcaaatggcaaggacttatggtgttccagcaaaagctgctttaattcagacgggaagtttgcagtttcacgaggaaaacatgagcagacttgagatacgaagccaaccaattcaataagttgcgaagttgaagtgctcatggtggtaccgttagtacctgccattgtagaagatccatttcctacatcgagcccattagtggcagctgcagaatcacctccagcaagcccatttaacataaaaatgtcccttagcgattcataatgtgcatattgttgaagaaactcctcttgataggactctgggtcacgctttaccaaattctgtaaaagaatgatatttgttgggagcatagctgctctacttcttctacccattgttgatgcccttgattggtatattcagtgcgtcttgtgcttcctccttaactattattacttattcaaaaaagtgacgtttgatatgtttttttagtggtagaacgttctatctgttaagcgtgttatggttatctgcgatgagatgagtttaaaattttcattttttagccgatcaagcaaaagaaaagaaaaaaaaaaaaaactgaaatttccaccttacccgtttttttaatggaacagtgattgttacgacattgagattttagatttatataatcacatacatattaaatagttaatgcacctttaattcttttgcacttcatgttctatatattttagccaaaaccaaatgtattgcgtctttatttccgttccctttttccttcctagggttgattacctaaacgttacctaaacaaaccgtcaatggcgtcgtaattaatcttcttggagaaacttgccttctgcaacatgttcttgacactatcagcagttgtgaaatcaccactttcctcagctgccttcaatgcagcgtgtaaaccagacttatcttgtaagtctgacatcaatccgatagctgctgctgcatccacagtttttgtaggttcgtcacttctagtattattcctacgtctcgtacgtttttttttcactgatgtgttacctgtggcaatatctgcctcctgtttcaaacgtttactctcttgttcaagtaagaaatctgcgttcagaccaatccaaattctttccttcaatttagaagcttcctcgtttaataggtgcgcgtttaactcctcatcatcaacatcttctaaattatctgggtcgtcactaactttcgaaaggtatgtgtccgttgtgggtaacaagtgtaaattgcgaggacaatatgggtctgtttctagagagtaaccatcaatggcatcttgaaaatgcccagattcgttctctttcttttcttctgatgtttttgtctttaccttcttgactttttcctcagtcccttccgtctctttgtcttccccttcaacatgctcgttctggatagaaacttcagaaagtttgcgtttccttgtttcgttttcagaaccttcatggtatatattttcaccatctataccattagtagccttaatcctctccacaacacgggcccttctttctgaaaattgttttaagtaaaacaggacttccttggaagacagttcttgttctcctaatacttgcgtcaaaattggatttttattcaatgcttcttcacttgtttgaaacatctcttctttgtctaaagagtcctttatttttctttctttctttctgttcttcacaaaggagggaggcctagcctcaccgtcttccacatcattttctctaaatttttgaactgaaagtttagcagcctttgtatttttgaattcgttcaaccgttgctgtaaagtttcctcggcgacatgtgaaactgcgacgatctctgtatgagttcttctcaaattattcatcctgcaagctagtagaatacatgcgccggcaatacctgcaggtctacgtccttcaaacatccagtccttggacattctttgagccaattttacggcatcttttaccactttgatcttcttgtcagcaagatccaatttttcggcaaaatgttgaatgaataaggaaggatccgctaacggcaattctgtgatatgtaatttctttaccattttcaaaaatgtggctcctatggaatacacactcacctgtaaccttgaagagaagtcgatcagcatatgatgcgtcttttcctttctacatgcaacgtaaagacatgaagcgataacattttgggacctacgaccttgtacaaagttattagccaatgcaagcttataccattggaaagcagcatctgtgatatattccgggatatgtaatgcgtaagaaacggcgcgtaatttccttcttgcattgttcaatgtggcttctctagattctagagcactagaaccaccaaatgcagcatgactttgtcctgcaccgataaaagaaccttgtactacagcagcacctgcacttgtttcaccgaatgtaacttcagagacgataggattatcttctgagacaacaccacaagctttacaaactaaatcgttgttagcattggaaagatctctctcaaattcggttccgtgacagttcttacacactggcattggtatatgactatggactcttttttattaccgtttttaccattgggattgttcttgatgcgatcaaaaatatgattttttttatcatacctgatacttcgcgaaaaccttagaatagcaaataaggccatcgcaacattaatagacaaaaattagagtcacttcacttcgttgatttttgatagcgacggccgtgaccattgcaagatttctaatgaggggaagaacaacttttcttgtagattacctccactttaatcggatgtctttttttacgtccaagagtattcaatgtcatcaagatagaagcaaatttttctaacactaaatgttatattgcatctgtatcagtatatatgtgtatgtgggaagccatagttcactacttcacaactttaaaaacaatctattttcctttgttcactaagtgattttgtaggcgtgatcaagtgcttaccggggggtttttattttttttaggttagatccgatggagaagcgatgcaggtgaagtttaataagaacccaattcgtaagcaggggcacaaacaatcaagaagttatcaaagtcacttttgagataccaagaatctaatcagattattttatcattttattttaccatcaattgtaattattctagtttgggaattcgcgatacttcaatttgctaatatcagtaaccacagaaaaatggcaatagcattatggtattgtccaccacaaggatcagttgcttacgagacattacagatgcttatattttcgtttcaaacgttgttcccagattcaccagtttttgaacctcatgtgacggtaacgtcccatttggtgtgcaatagtaaagatgatgtcaacaaaatcttgacctcctgtgttgctgccatccaatcgataaggtcacaccaaacagcaaagaaaggacgtaagggacaggtatcccatgctgttgcagctcctttggtatctttcaatggatgcagtgtaggtaaacaatatttcaagaaaattgtgctcgagtgtaacaagaacaaaatactttatggggtcgcacaagtcatgagagagatgtacgtagagatcgatcctgagacgcgaagtagccgtgccgccacttgggtgcacgaggaattccatcctcacgtctcattgctttattcggatattcatccggtaaagtcaggcgtcattgcgagtagttcaacaaagaattagtaagatgctctagacgtgcaactagttccaagagagaaacgtaagggttccggaaacgctgatgggtccaatgaagtgcaaatgagatgggattttgacgtatcttcatcgctatcttggaatatcccaggaacgtttaaagtggtcaactgtgtggggcccgttcaagaatgggaggtattgggacgggtggacgtttaagcatacatttatgtgcactgtaagtaattatatagaattttttttttttttttttttcatatctgtcaatacttgaaaatgttctagttagagatttacgtatactgatcgcttgccttcgcaagggatggaaatcccttgaaaattaaaaaaatccccccctaagcagcgaaaattgtaagatccataatatttaagaaatgacgaagaacgtagtcttatcgcagcagttttccaaacaaagaatgccattcatcaaataatccacaaccacctcaagaaaaatggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaattacactcgtctttatacgaaactggctccgttaatcacgacagacaaccttaattacattacataataataaataaatgacaactgtcttctttacagcgtatgttggagcttactcccgaagcataaacccagttcttctagaagaattgacagcagaaaggaaaggggtaccgaaggcaaactcaaccttaaaagttccgtaagcaaccgagcctccgcgaaggttgcataacttaaaagaaaaacatagctcacccggtgataccgttacaacgcgttaatcttaatgctatgactcggaaccacctgcaaaacagcgctaacggaaatttccatggaaatagaataagggacgcagcagggtttttttttttggcgagcacacgaaatataaaattgcttcgggccagctgcatggaagggttaatttcgcccctttatcgcaagctacgcagttctcctggctcgagaatgaatctggcccgccgcagacgtttcctggccccagattaggaagcagcggcggcggaacggaaggtgctctaagcaaaataaggaatattagccacgccggtaattcccctcctttggtctgcccctggtctgcccctttcgttttttatttttttttgggtgaacggaatactccgtgggcggcacaaggagagcctgcgtaggaatctgtgcgtctcagtcgggcgggccgatttagcaccgatggttcgctttggcttgggcttacggtgactgcgagatttgcagattagtgcatatccgcgcctttgtatgacgtgaagcgatccgccctgaacaacttgttacgtatatgatgttgactctgcgcccccgtctctctggttgctgccttctgcgctgatttggtgcaatctttcttttttgtctttgaaagatttaagctttttttcgagaagaaaaaggaggaaccgaaaaaataatctttcagttgttgacccgtagagcagaaaatggaaggcagtagatatccatatcgaaggaaaagcacaaacttatcacgtttagggtattcattaacgttgaagtaatcaggtagtgaatagctcgaagttttccatgctttcctttcggttgcatctttcttcctttggggttttatcttgatacgtcgttacttacctttttttccaatatatatatattggtagtagctgatcattgcagaagatctagatctcctttacacgctttaaggttaggcagctgtaacccctatattgaattttcacccacgccataaaatacaatagctcagagaaccggtggccacatgcaacctaaaactttcgtccaccaacttcatgcaattcttctggaaccggaagtaaataaatggatatactggtctccgactgataacacggtattttttttgaagccatatgaccctaattttagtacacatgttctgaagcgttatttcaaacatggaaatgtcaatagttttgttcgtcaactacacatgtacgggtttcataaactatctcatccttccccagaccaatcttctgccaacaatggtaacgttaaagaacttgttgaatggaaatttacccacccatctggattcttcttcaaagaggccaacgccggtatcttgaataaaatccaaagaaagagcactggtgtgggaaaagatggtaaaagaaagaatatactgtcaccaatatctgtcagttacgttgatgcttcgaggttaaatgttctctctcagcaatccggaccagtttctgcaagagaaccatcaaacatgtttatgggcagtcccgtccattactcaacatcccaaagtcctccacatatcagtataccgcaacagcaacaaagtagtggaccttacctaatatcttcactgccccctcaacaacccacggtgaacatgatgcgaaggcaaagcatctcggcgaggatgatgaattcttatgactatcccaatcaattttccacccaagatagcatagtccagcctcagcagccgcaacaagtactttctccacaagcattatctggacctccgatgaagaaatcaggaacactatcttcgacagatgatctgaaaacaacttccttgccaattgttaattacccaatgccgtatcatcctggagcttttgcccagcagcagcagcagcagcagcaaccgctccctacagtcccgccatatagcagttactccactccatttccctcaatgatgaactctctttcgaactctgcttctaactcacctgctttaggagtttgtaataataatgtaacactacccaaaaaaagcaatataagtgaaaggcaagctttggataaccatatacaaactttaaagaactctctatcaacaatcactgatttgatagaaaaacatattaacagcgcatcgcaagatgaaaataaaactctaactaatgatgccatgaacaaagaccttcgaacaagcttatccctattacagaattccaaggaggaaatcattcaacttgaaagtaaatggatgtctatgcaatctgttaaaacaactgccctaccccttcaagagactacgaatacatcatcgaccttaacttctctgacgtccagcataattcccaagagtatacctataatcacgaaaggtgaagtcgccactaaaccagcatcttactgaattattttcaacagaacacatcgcatccaactgaacaaactgttaccgctgttgataccaaggaacattcagtgaacgtagggaagaacgaacattctccatatttttgcatactagatacaagggggaagaatgcaattatttcacaaaccgaaagaaaaagaatcacaagctatgtttgctattatcaatttttcttatgattaatttaacataaattatggcctttttcattccggctgcgcttgttctccaattttttttttttttttgagaaaactttaaaaatttcaaatgtaagaaagtagagcagatcttttagcaaggatccgcttaacattccaacaaaaaaggaaaaataaaacaataatttcgttccccatctatccttcgcctctccttcgctctgtaattttttttactcgcgcgcttccgacttttgaaagaaggagcaataaagttaaataaatgtaattaaattatgcttttttaggcaagttcgggactttgttgccacgtattgctcttctatgcaagcacttcactccttttctttcatctctgttttcttccactggctggaagcttgagggttgcctcttgattctttatcgcctgcaaccattgccttgttccgtcctctcaaggcgttccttccgtgctttttaaatactagaatcattcgagacgtatttatgagcatgttacttcttgatgtttatctaagagggttgtttaggttatccgcattatttttaaagttttaaggttacatcatttattcagacgcgttcggaggagagtgcattcaccaagatgtaaatttcttcagttttccggattaggattggaaaaatgaagaaaaatagctgcagaagagccgaaaataggtcagaaaaaaaaaaagacaggcaaaataggtgtaagcgttaaatgcctattgcctgctgtactagctagctaaagtaattgtagcagttgttattaaggagttctttaaatcatattgcttgcttgtatcagaccattggaaacttcaatgtttaaactctagaaaggttgatctgctcaaatattttcatatttacggcatgtcctaacttgaacatttgtagaagagagacatatttcttagtgtaggcaagatatttgaatgacattgtctgccgaaatatactcgacttgcagtggaactgcaagtcgaaaaggatatcgctttagccaaacaaaaatttgttgtgctattcagtgagcatgcattggctatagaggccgcacctaaattgtatcttttgatttatgtaactgccacactttctctagcacagtcatgatacggctttttttcatttagccaccaaatactgtaaatatcgttttagaacgttatgaaaaaatgctcatccacttaaaaacctctccgtattctgaaagttggtataatcttgcactttaagtgtatatctttttatgcaatctttttgaataatgagtgtttttcaaaattttgacattcatgtgaattgtttatctatcctttgcatagtaaaaaaatagatgcagaatttactcacctcaaggaggggcaaagtaataagaaaagttaccataggctagttgaatgtccaagatcgtaaagaatgaagaaaaaaggagtaaaaagtatgaataagataaatgaaaatataaaaataaaaaccaactaatacatgaagaaaaaaaagcagacaaaaacattttatggacctgatgcaatctagtagtccatagaataatcaccactagaaaattcttcctcttcattactaccgtttgccattataggaatatgatttgctgcaggattctgcggaggtattatatagggcactggcggcacctgtggaataaacccaaatgatgggaacattggcatcatccagttagcgttattttggtttgcacttattaagttgtaactgttcacgggctttgtgttggtattagggtactgcagtggtatgaaataattttccctcgagacttgctgttgcgattggttctgagtcatcaaggcattgataaatttcttattatactttgttggataagccttatgataatcattatgtggctgaaaattttggaactttgatgagttatcagtttgggattgatcatcatcatcacttgaagataaattaccacgtttctgagcgaaagaaacagataacacttgatctttgctcacttgatacccgtctgtattcaaaattgccttagcagcatctaatgggctttcaaaagaaacaaaaccataacctcttgatgatcccactggcagatcattatctgatgagctatcattcgattgttgacgatacttgttcttactacccccaacagtaatgaccttaacgctgattatttcaccgaaagatttgtagaaatcatataaatcttcatctgtccaagaaagagggatgtgcttgacatataggtttgattcttgctgattactcattggtataggtaagctgtaagaagttgatgggtactggtacatgtcaaacttgttgcccatgaatctaggcacacgttgaccacgaccttcactgaaagattccctttgaggatagaacagatccattttctctgccacaggggttgatcttacagaatcaaaataccgtacattggaggtatcgttgctgttcccgtttttattattgttgaagtaatatctatcatatgtataattattgtaatcatacattgggttatttgcaaattccaaaacctccatatcattgtggttactgatggaagggtgcctgtcatggctattgtggttgttgtaaactttatgttgaaccgccttattaacaacgagcctgtttccatgccacatgaacccattgaaggtctcgatggctgctagtgcttgttcatggttgataagcttgatgaaaccataacccttcaacatatcttcatcttgggcatttccattagtattattggaagatttgtttgattctactgacccctcctcattgaaacttactgaactactgcttcttgtattacttctcttcggaaagtaatatgaaatgatatcaaagtccggaaacttttttgataactccttcttgattacttctatgacttctttaggtgtaatcaaagtctctactttttcaggattgtgataaggcaagttgcctataaagagacacctgaaattatcatcattgttgttttctttgacatggtcccaatggattctttctctctcctttcgctcaacgtgatagttgataaatagtgtggagccatttaccgtccttccattaagttccttgatgcaaagtgaagcttgagaacccaaggggtaggagatgaacccgtatccgttaggttcgcctttcgttttatcatatatcaatttcattgataaaattggtccatattttgaaaataagaaacttagttcaccaatagaaaggctctttgctattcccccgacaaaaatatttccaggataggttagtgcatgcttgttcacaccgatagaccatttatcaatatgctgaccaataggttcgctcttgagtaattccgagatatctgtacatgcattttctaatgacttggggtacttgaattgtgcttgcaaaacggtatcgtatctccaatcatcttcctcttcgttatctttgtaagatttctcatactcttgacttccatgctcgtaaagatagatgtctttattttgttcgagaacctgtaacctccttgtatccggaagaaattcatatgtttctgtatcagagttgttaacggagatacctttgtagtgctgtattgtgtccattatttgatcggttattctagagttgcagtgatcatcttcttcttcttgtaactgccattttattcttatggttaataaatttgtgttggccaattgttccagttgaagaccagtggaagttttcctttcaatttttattgattggtctccagcttctgcgctcgctgatgtctgctggctgcagatatctgtatcctcggggccactagatattacttcatctgatggttcttctgcaatattcatcctcgaaacttctgatgcggtttgtctttcacgtataatgtttttagtaaaataaaacttatggtttatttttggatttttaatcagggtgccttgtaatttgggatgtgtgctatgctttacttgttcacactttttttgagaccgttgaacgaactaaaattaagaacactctaatccttcgaacaaaaggcacttttcaactattatttacttattcaatatttaagggaagtttctttattgtgcttgacatatatatatgtatttatttatatagcgcagtggccaagaaaatgttaacgtgaaataacgactaacgggcaggcgttatgcacggaaagagatctactaaattccgcccaatagggaatctccgactgaatttttttgccctttggtcaactattcccgggaagggcataaattgaatcaagcgccaattttacgtcttcggctagtaatcggatcagcgggagaaacatcgtacgtacacaagagaataccgagagtgtcgattaatcaaccacgctccatgaggcttatccgcattctacttgcatgttagccgggaaaagacataaatcatctcaattctctagaatactctagagattatgtaaaagcgtagccccgtagatgattaaataattttcggtttcttaccccgtaaccacgagttgcggtgtttttgcttctatcggggcaataagcgggcgctgcttctcgggaatgtaaaaactgtgcttcctaccatgaagtagttggatcttgaaatgggttgggccggaacaatatgcaagtactacaatccttgtattcccatatgattatattcccctttgcataggctagtgttttttttttcgttcttttgtttcttccgctaggaatagtagtggcgatctgcagaaagacgctctaaggaaaaagagagaatttcgatcagtcccgtacacattactcttgggaagttcaattccttcggacgtaatccacatacgaacttggctctcatctgttgtcttcaagctgttgcggccctcctctttctctctgttgtacacattttttgactttcaaaaatatgccgctaaggaaacataacccttgtgtatgtgagcttgtagcatatgatatagtgctcattggcatgtgacaagaattgcgtatgtaattgaagtttgtagtgtaatttacgaaaatagccgcccttcttcttcattaacgattattgagcgtaatgatataagatacaacggtttatttagggctgcatccatgaaaatactttgtaatagtgagtcgtcgccttgtttgtttattcaatacaatgcagtgtctctatagtctcctcctttagtttcactatcttttctaaccgccgaagatatacgagtgttctgaacgaaaaacgaccttttcaaacatagaatataattgtatatatacatatacatatatgatacgcagccacattcgtagtatctttaagacactgcctttcaaaaaagctttggtattttgaaagaagatcgaagccaaggaaccaggactacaatgaattagacgctacaaagtttcttaattggaaaacaaggagggacaaggaggagacttttacagtaaaccagaatgctccttcactgttcagttatgtaatgttattgtttggaagatctgaagagaggcatttcctacaacctcttgaataaaatagtggaaggcatttacacaaagaagccgtgccactttggtccggattttttttacctaaaatcgtcttaaattggcctgttcgatagctgtcatttgttttagatatttatttcctaacgtcagctttagttacagtatgtatgtatcaaccttttagtaagacaataatgattgcatgtttgatcctgctttaaaggcattggaagtaaccgtagtggccgctgtttcttcttgacggcctgtaattgacctgcgacgcgggcaatttctagcgatgagattggaaaaactaacgcataaaaaagatttcaagatttataagatgttgaaacaaatcctcttctcacatctacagttgatacagtataccgtattatctttcctcggtagtgttcagaatgagtagggccaaagaattacaagagaagctcaacttgcaagcgaaactccagtctactttcagtaacaatactgctgcagttttggactggctgaaagaatcagatgaaaccggcattagcaatgatacagagcgtaacaaacagttaaaagatcacaaggagttggaggatggtaagaaggcatttttcaagcttcccgttttgcagattggatcgggcctacacttccgcacacaagatgacgcttccgccaaagaagatatacatacgattggtgagtttattgagggtgataaaaaggtaagttcgttggcaaagaaaaagaaaagaagtgacccagggttgcaacgaaataatatgtacaggatcactaaagatgatacgaaagccatgattgcgcttaaaagaaaaatgaggaaaggcgagaaggaaggactaaggaagaaacaagagcatagcaaaagcagcgtttcgaactcatatagtgccagtgatgaagaggatgaagatgcagggacaatgccgcaaaagtccacaaaaaaaaaatttggtttactttttgataaaaaaaagaaggcacgtaaataatcttaaacacttatgggcagcaaaaaatgcgtctttcttccctcgtctgttgttttatgtagggcgtaatgatgtttgcttgtcaacaaatgaatacgtacagaagagaattctagccaaggcaattattgcatactgcaagtactgagtacgttaacgttgctagaataacattaaatgagatgtagcaatgcagatccttcctcagtaggcttaatgctccactagaatttttgaccagccactatttgcttttttcgcaatccttttcaatactcgagagcaaagacaaaaaaaataagacatgtagtgcgctgtatggaaaagaattaattagaactttacaaacgcgtgttaaacaggcatatttaagtgtttggacctaaacaatatatcgactattgaaattcttacgcaagattttttatagttggatattcatatattcttacaactctctctactttcagttttttgaagctatatgtatcattatatacgtttatggatttttcaaacctaaacaattatactgcgtaaatgtttgattaagcaataaataaaaacaaaggattggtaagggaagaccgtgagccgcccaaaagtcttcagttaactcaggttcgtattctacattagatggtcacaaaacatcagattgaagaggatcacttggatggagctacgacggatcccgaagttaaacgggtaaaattagaaaacaacgttgaagaaatacaacctgagcaggctgagaccaataaacaagagggcaccgataaagagaataaaggaaagttcgagaaagaaactgagagaataggaggatctgaagtggttacagatgtggaaaaaggaattgtcaaatttgaatttgatggtgttgaatacacattcaaagagagacccagtgtcgtagaggaaaatgaaggtaaaattgagtttagggtggtgaataatgataatactaaagaaaacatgatggtcctaactggattaaaaaacatttttcaaaagcaattaccaaaaatgcccaaagaatacattgccaggttagtctatgatcgaagtcatctttccatggctgtcattaggaagccattgactgtcgtaggtggcataacatatcgacctttcgataagagagaattcgcagaaattgttttctgtgccatcagttcgacggaacaggtacgcggttatggtgcgcatctaatgaatcacttaaaagactatgttagaaatacctcgaacataaaatattttttgacatatgcagataattacgctattggatactttaaaaagcaaggcttcactaaagaaatcacgttggataaaagtatatggatgggatatattaaagattatgaaggtggtacgctgatgcaatgttctatgttaccaagaatacgatatttggacgcaggtaagattctattattacaagaagcggccctgcgaagaaaaataagaacgatttcgaaatcgcatattgtaaggcctggtttagagcaattcaaagacttaaacaatatcaaaccgattgatccaatgactattcctggcttgaaagaagccggctggactcccgagatggatgcgttggcacaacgtcccaagcgtggtccacacgatgcagcaatacagaatatactcacagagctacaaaatcatgcagcagcttggcccttcttacaacccgttaataaagaggaggtccccgactattatgattttatcaaagagccaatggacttgagcaccatggaaataaaattagagagcaacaaatatcagaagatggaagacttcatatatgatgccagattggtgtttaacaattgccgaatgtacaatggcgagaatacgtcgtattacaagtatgctaataggctagagaaattcttcaataataaagtaaaagaaatacctgaatattctcaccttattgattaatgcgtagaagaagcttttccgctactattcctttcgaagaagaaataaatgtttagtacggcgagacgatgtgatcaattgaggttattttactacttttcctttcatttttgtaaggttttctttctttgttagtgtgacgttggtatttacctttatgtaactatatttatgacatttcaacatccgcttcttctggactttctgcagcttctttctctttcaactcttttatcaattcagcagttttttcgttatcatatattttgaatccgtcttgctttgttatacaactcaattgcgcgttattttcatcaagtttctcttccatcacttgctttaggatttttagaacaagaagctcagcttctttcaaagttaaagaagaatgccattcattcaataattctgcttgtgctccttcagagcctgaaccaatggctttggcattataacggtaaaatgtcccagatggttctgcatggaaaagttgataaccatcatccgcatcatggccagcaattaacaaggcaaccccgaatggtcgagacattagtctttcttcaccagaggcaccttcaccgaaccttagagcaagatcacacaccgattgcgttaaggactcaacattgatgtcttcatcgtagtatagattatgcgttactgcagcagtacgcgcatgttcaatcatggaacgagcatctgctgtaagcccactcattgcacaaccaatatgacgatcaatctccacgattttctcaatagaatcagattctaatagtggtgaggtggcacgtttctccacacctagtacaacaccttctttcgtggcaataccaattgctgtagatcctaatttgatggcctccaaagaatactcaacttggaataacctcccttctggggaaaatgtgcttacaccacgatcatattcacttctagttaagaacatcctttctagttatattagacaattggaatttatgttcttattgacttgtattctatagttatagcgctctcttgtccaatttcctaggttactcttttgccaccggtcttggtttatgataaccctgtataatgaaatttcaaaaatattttcgtgaatagtgatttatttaatttaagcactaaattatccttacggacttgggctacattcatgtttgcacgcttaataaaaaatcggcgtactttcatctatgcttggcttataatatgtttgatagtcaattcatttcagtaaaaagtcttcagcagtagttgcaaaagtgtccttttttactttttgggctacattattcttgaaaaaagttcatgttttgttatttctttctcacatactttataaaaaaagataatttttttaaaaaaaaaaaaaatacaagtggaacattatcaaataaaaagcattatagcgccacatgcgatgaacctgagcttttatcttcattaatatatagtaattacaacatgttattgaaatgcacagcacttatccagagttatttgatataaagattatgactcaaattcttctcgacaaacaagaaactttctcacctacaaatgtcttcaacaattctaataattgacacataagtatattgtatatataacatggatataaatggccctatattgaaagctatgtcaaaataggaatccttccttcctcagcgctttttatcaagggccaattgatctgatacacctagtagtgtactataagtgtagaaagcatactatactattcgacacttcctttcaatcctggaattaacagtcacttttaaaaaagacatctaccgtgaaggtgccgtagagtatcgcgttaccatatcgccaaaaactgatatacgccgcggaaaccaggcaaacaattgaaaagaaaaattttgaggaactctctgcatcgaagccgtctagagttaccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaaatggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataaagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttccattgccttttctaaagcgtatactaaaccatgaacgtctgtttgccccatgtttaacccctgtccagcgagaggatgtgtcgtatgtgctgcgtccccaacaagggcaactctatcagtgcaataacgatctgcatgtgttaattttaagggaaaacgtgctcttgtcttatctattatactaacaactcttggtgggtaaatttcatcaatatccgactcgtccttcaacgtggcgtatatttcctcagttctgaatttaatatcttctatcaatttatcggtgtccatagagccatcttccaatgtacggtaatagtagttcatgtctgcgtcttccaagacaaaagcagcattgataagtgcagtgaatgattctggaggtaatgacaacaaaagcctcgataaacgttcagatgaactccagactaaagtagcattattttcaggcatgggtaagtgtgcaattggaccagtgggtaagaacctctgccagccccttagtttaaagggaggatactctaacttcatgctggccacaacaccataggcattatacatccagcccctagatgggatctgggaaaatcttctggtaggagaattgaacccgtctgcacccactagcaatctcgtcttgtatacttcaccattggaaagagtgactaaaggccaggacaatggatcattagggtcgctgtgtttaatattgacaacttttgtattatcaataatatcaatggagtccttctttgaatcgtactgagaaattctgttgtataaggaggcctgtatatttataatttcaatcatacaaagcatggagtcccttgccagatccaaagtagccttagaacaaccgtccgtgacatagagtccgtcataactttgaatcctgtcatgcatcaaagttgccccagcgttattctcaagaaaatgaatagatctaggcgtaacactgacaatcctgttcgtaaaataatctgggggtgaattataaaagtccgataatttatcttttaagtccaccatatcgactaaagttgtctttagatcttttaattgcggagaattcttaatcgatgcagctaaagtcaaacctgcaggacccccacctacgattaatacatctgttaactttggagctgaagatttggctgttgccaaacccctcaccaaaatacgccgagtaagcataacttttgaaaagaacatgcctctgtgtcaatcgatacaaggttcactgaaagaccaatttgagttactgaatgaagaaaattatcgccacaattatatttattcctttttaatgtcgtatcacaattccagaagggatatttctcagaaacagtttaagatctgcgtgttccttctgcaagaagaagggaaaaaaagaaaggagaaacaatagcagcataaatcttgttcgataaaacaacatcactttttcttgaaacttcaagggtttgcctccttagcttagtggtagagcgttgcacttgtaatgcaaaggtcgttagttcaattctgacaggtggcagtttcctttttatttgtcagtattaataattgaggcgcccctaatttttttggcaccgctctcgatgaaaaagtagagacgtcagaaattgaacgtttcctctaggagtttattaactaataaccccgaaaaatggctctttaaccacgagtgcccacggaggttatcttcacccctattttcattttaaattttagatcactgctaggagttagctcaaatatatatatatatatatatatggagacaacgtttgaagaattcgtaggtgcaggtgagcatattgccggataagtgtagttacgcaactacaattaaaaaaacacgaggaacagaatgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttggcgctatcttaattactctggctgccaggcccgtgtagagggccgcaagaccttctgtacgccatatagtctctaagaacttgaacaagtttctagacctattgccgcctttcggatcgctattgttcatcatggatatttgccatctcgtcttaccgacatcaaaagggtgtgtgcatatagcagctatcatcccacttatgcaaccactggcaaaactgtttataaaatggacccagtttgcgtccttagatgcaaatcgagtagaatctagccatagtctttccttgcaaagttcataggaactccaatatattgcactaaacggaacgtctctccacagagtgatctccaaacctttgaagagggcccgagaaggacccaccattttcatttcctgcctcgtttcgtttaataaatctttaaccatcatccatgtctttgtggactttgatgatctcggtatactttgcagtttagttttaaccaattctaaaggtgcaatacttgttgctgcaaataccctcgcaattgcaccacaaaagagggggtttaatgttgggtacgtcgaggctataggagaaacgtctcttatatattcataaccactaaaataaaccatgttggcaggaatagccattaatagggtcaaagaaatacccctccacaaacttgtaataccttcgacgctggcaattttcgtgaatgcttctaaagtaccgttgaacttcaacgatgaatttttacagtgcagttcttgaaaacaagcactctcccaaaatatttttgcgttgttcaagttctgtcctccgacgttggtgaatgtcttcattttggagcctgagctaacggcgttgggcacttcggcagccccatcacatgaacagtcaggaatcatctgctgctgttgcagccgtattctcactacatccatcggtgtcaaaatcaaagaagtgagtactgatccagcaccggcacttaacattcgttcttttaaggtcaggctgttacttgtattgcgatcactcatatcgtattatcaacacctcgtttcctttcctacgatactttatggctttggctcatacgattcctgtgaagtgaactggcacaaatatgagggtagtgtgccccaattccagaggagtgatcttcccggaaatatgcaaaaatgacagaatgtgtcttattctctaattgctattctgagatcttcaagatggcgaaaaataacgttgcgcgtgtttgggtgggtgccaaaagtgtcatacctcaccgacgcaaagataccaaaaggaccgtatatatctactattcctggatcggttgactttgttaacatgcagaaacaaaggtaatgtttataaatagtaaatcatacataagtatatgttattacatctttcttttctttagtttacctgttgcggttgaaattctcttacttgtattgagcttcttatcaccagatatgtactcccttggaaaaaattcattaatccttttttgcttccccttctttttgcgtttattaacatctctaattaagggaatgagaatttcatcagacttttcgtgtggccaacctagttgagtcttcatgaatgaacgaagcatatcgagatctggtaccccccaaacaaacggcgtggtatcgtgatcgacttctggtctcatatacgcatcataaaccatgacgctaggaaaatcatcatctaagataatttcgttatttaccagtttttttctcaggtctttttcaaatttattttccgtttcttgcttacgtttatcaaactgcccattattataccagtctttaaaattttttaggtttccaaattctgcaatcacttcaatgcttgaaacgggacccatacccttcaatccattcgtgtaatcgctccctaaaagctgtgccaactcaatcatattctttctatccaagcccaataattttaaaatagattccgcatcataaaattcaacatagttcttttcgtggaacatatttttgtagatctttgtacctccaaataggaaaacatcactgtcatcggtaattataccatcgacaaggtttagttgtaacaattccgcacactgtgcttcagcttccataggcgcagtgatataggggattccaaacctcgatagtaattcttgcacttctttgatcatatccatagttacctcatccgaatctcttttatccttcatctgttgttcgaataattcatcctccacaaaagcgttctcggcaacgtttctttcagcagaagtggacaaagtcgtgtttttaaatgtatcaaactcttcttgttcctttatcatattttctactatgttatcttcttcatcttcggagaagtcatagtcgaatataagaggctttctatgctccttatttatagattcgacttttctactatcgttatcctctgcttcttttgaaatctgagatttagtgggaacgtcctcaaatagttcttctgataaaacttctaagtcatcgtccttgttttcatcattggagctctctttctcgctttctctttctaatatttccgtagcatttaagcctgtcaagagttcatagctactccctttattggtagtttctgctccactttcttgttcatttcttacgtttttatcttccacgaaatttgttgtgttatagggattatacaactgctgggaagcagttgaagaaaaccagctcggcatttcaggaattggagacttttccttcgtggcttcttgggacacattactctcggtattcttttgaaaaagcagggaattttcattgttaaaatcaaactgtggtatcttgtgagaaataaaattcaggttttgctccccctctgttaaaatagcccctttatcctcctgctgagacggtggcctaaactcagaaagaactgtcttgctggtccttttgatgaccgactctgatttgctattcaaatttgtgacatgatacggttgcttactatccggttgtgcgccaagtaatccatactgtactattggtggacgagcctctgtaccttttgacgttaccggcttagcgatttttgatttgtcgtccgcttcaggtttcttttccatcttagaaagttgcactgcctccatcatttcaatttcctcaatttgtttcaggtaatcctcatcgtcgtcttccacgctgattctgctaattctcattgttggagtagtcttggagggcgatgcctgatcatgtcttttgtccaaaaacgatttactgccagcgttgtttagggattggcccatgtaaggcaaccttgcagctttcaaagaaaaatcttccacaaacttgacgttcttgggcttgagttcaacttcttcccactcacattcatcagagtcacatccctcatcttctgaccggttactccttttctgtggagctgtcgtcgcgttagaagactcatgtcgcactatttttaaggaattatcttccaaatcatcccatcggagcacgtccccgtcctcagcattactatctaactgctttaccaaagcgcctgcatctttatcgtctattacgattgctttttgcgcatcagagccatcgtttgcccctagtccaagaatccacccgttattagtcttagtcaacttgtactctttactcttttggccggatatcctattgatcacctcctcgttcagcttagacgctccaccatcctgaaacccagtagtgttgattaacttttgagtaaaaaaattcctccttttcaccatgtctatttgaaatcttgagaaatccatactatttgggaagatggtctccaattgttctttcgagtatcccatcctcagtcttgatttcaacctcaacgacgataatatcaaatactgtgtggcctttggcagctcttcaaattcggccgatgctggatttatagtgtctaaatcaatgtcttccagtccatcaccgtttatcgaattcatcagtttttcaaaagttttattagagttaactcttgcatcttccttatcgtatttgaatcccggtatatcgggcaagtcccactcgtcctgaggtttgaagatctgcacactactgccactactcggtgtagagttttttacgttatcgtttgagccgttttgcaattgtaaagccagcagcttcctagcggtggatttcgcactctctcgttttccctgtcttctttctttcctctgccgtattgtttcccttttcaatacgggcacaccaccatcaaagacgaataccggcctaatgccaaagtataatagcttacaaattcttctaaagaacccagtaatatgagaattcttcactgcattcccctcctgatcacggacagctttcaaaaactgatatatccaaatggaggcatctactgccattctcttatcttccaaggattccagcctgaccggtcttgccgtaggacctgcaatatcccaaaatgaatgcacacccatgtctgaagtttggcgttctcccgaaaatgcttttcttcatggatgacgtgtagaaccttcaatgatttacgtacagtttttcaatccctttaaggtctctatatgtggcggcatcttttctttttcttttctttttttttttcactctcccttttaatgcctccacggaggttcgaatgggttatactagaaagaaaaaaaaatagtgataattaacaatgaaaaaaaaaaacagcaacaaaatgtggtattggggtcacaccactcattgactcacatcctctggaaacatcaaaaagctaccaaaaaagaaaaaaaaaaattcaagtgcgaagtttccgcatatgcaaaccttacttattgtataatattggtaacagcagctactaagctccctgactctgatttctctctctgtctcttttgaggagtaccttctgcgctactgtgttccaatggtatctgcgccttgaaaatcaatcacaaacgctcttgctatggcctgccttggacacgatacgtcgctgcttatgccgccaggtgtcagtaaatgctctgacgcacccattcaccccgcgcactaatttgcaaaatttgggggcagtttgggaatactccatagaaaaaatcgacttcaaatcaattccgcacaacgtcgccgtgttggctaaagtgaacggaaaatggacgacatggtaaaagaacagatatgtacatatacagaagccgcgatttcacatgccggccattatggcacacaaccaggtcttgtactgtcactatgtgcgttccggaacgcctgtacagtccatggtgaaccatttatttatttattattattattttgtacattattatttatgctatatgttattattattatcactatttaatattattattcgggtccaggtgaaataacaaagtctggcgccagtcacttgtctgggtgcccgtattctctgttacagcggtatccctctggattctgcaatcgtcgccggcttctactaatttttcctttccttttttttttttttttagttttttattttctagtttcctgctcgtattctgttggtttttccagtgtctctctccttttacaagtcacccattctctgcgaagaagcggtcgcaccaacaaaatagaaaataccaccggacgccggatcgcttattactcgcaatcatagttaccaatcacagccgggcatactcgggatctaccgtagaatcctatgcgtcacacatgaggacaggttacgaaccgtcgaaggcttcgcggcgtgtgtgattagtattgttttgacctcatccatacaccctgaaatatctgtcgcatctccgattacgttaaaaattctggataatatataaaccatgagttttcctttctttgaagtatgttcctactcgagatccttttgttattttattgccatttttttttgttttctatatgtacttcttatctactatttatatttctctatattaactaactctccaagctataagcatacgtccatatttactgtcttagaagtcgtattcacatcacagttttccccctcttcgcctttttcaaactattttcccccgtgagacagcgactgaaaaaaaaacgactgcgcagaaggcttatataaaaaaaaaaagaaatatttcttcactttcgagcattgaactattgtcattacctctagatgagcaacaaatttacaatggagtcacctaagcatttggtggatgatgtgcttttcatatcacccaccaatgatggatcagaagaaaagcctacggaagtcacgttccaggaagatgaaggccatgacgctagcttgcataatcgcagccatgacaagaagtcggaacttgccaccgaacgggaaattatggctactaccacggatgatgacggcatcccctccccttcccatccaatggaaaagcgtgtcttgcgcaaaatggatatatacttgattcctcttatggggatgctatatttcctttctaacctggataaatcgaatattggtaacgcagaagttgcaggtctatccaaggatatccaccttgtaggaacgcaatataacacatgtgtcacagtttttttcgcgacgtatgttcttttcgaccccataggtactaaccttctgaaaattatgggtccgccattaatgatgagtatctgtttgacctgtttcggtgctatttcgctcggaactgcttgggttaagaattatgctcaattgatcgttgtcagactactactgggtgcctttgaaggtatgatttatcccgctattaacatgtacctttcagtctgctatagaagagaacaatatgctctgaggttcgcttttgtcttcagtgcagcctgtttgtcttcatcttttggtgggctgattgcttatggttgttccaaaatcagcggttctctaaaggactggcaatacatttacattgtcgaaggttgtatctctttggggttcgtaccattctatgccttcgggttgagcaaaaatttggaggattcgtggtttttcaataaggaggaaaaagagtacatttccgaaagatacaagactatgaacacttttgacccggacgaaaaatttgaatggttccaagtgtggcaagcagttaaggatgtcaagacttgggctagtgctgtggcattattcggtatcgatttgactacttttggtctaacagtcttcttgccgatcatcattaccagtatggggttcactaatgtcagagctcaattaatgaccgtgcccatctatttccttacagcaattgtgttcttcatttgtgccgtttggtctgatcgtataaagttgagatctccattcatcctgggtgcttgtctgacgacttcgataggcatagctatcgtccttggttctcaagttcatggtgtgagatattttggcgtttacattctttgtatgggtatttacgttaatgctgcctgtaactgtttatggttaagtggtaacactggtaattacttcaagagagccaccgctttaggaattaatctatttttcgggtctggttcagggttggtctctggtcaaatttttgttgccaaagacaagccaagatatatcaaagggctgtcgattagtctggcctttcaagtcttctccatatttatgacggttgtgcaaattttcctatacaagagggaaaacgataaaaagaaagcaataatagatcgctgtaatgaattgggagagcctattccatacgacgaaaggttaagcgacaaaaaccctgagtttaagtacatgtattaggcttgactttcttcaccctccactttttttgcccctcgttatgagtgtgtttgcaatttgtaacttttcttttatatttgtatgtatttttgtactaagcaaattcacatgaaactttgtttaccaacttctcttttgttttcgtcccaaacacgtatattactgggaagatatacatgcctatatctatatctataaatatacatatttatatagtattatctccgagttctaaagctccagatgcgaagaagacgttcccgaagaagacgttcccaaagaagagtcactatactcatcatcgtcactgctctcttccgattcgtcttcatcctcgtcactgctttcttccaccacctttataattttccttggtttactcttcctttctggaatgtcggaaaaaaactcgtccaggctttgcaaacgatatttcttcccgttttgagatgtgaaggtgtttacgttacctttacctgagatgctattgctatcgccgtcattgatcccagtcaattttgcgttggagctagatgtgaaagatcttgctgagttgttggtaataaaagactgggatgaaaaactttttttgtatttgttatagtctttcaattctgcgccttctctaatatcgttacctgtctcgccaacctcagtaatttcagtattccaaggaagcattctaaaaaattcttttatttctggggtatgtgtttccaatcttgcagaaacgataaaatcgtcacttcttgccgtaggtttaggtgcttgtaatagtagtgacacaatttcatatttccctgaatcaaacaaggatgaaatcatcctggctctatccctaatatcaaattcgtcatcatattttgccaagtaaaggaccgcattgtacatttgagagattcttgaaccactaaaatcatagtatgggggattttggttattttcttcgcttccagtaacttgcgcttgcttaaaattatcaatgtcatatgacaacagttttgctgataacactaagatctgacatcttgtctcaggaccctcatttgaaaaattcgggattagcctcctcaaaacgtccggacatatcttaaattcaatcgaggcaatttcaccaaataaccaaacaatacctgcacgagcattatcagccaaactcgtttgaactgttaataaatctgcaagcttgaagattatgcgaagatgttttgtaggatttttttgcaccagcatcctgataacattcacgtatgcatctaggacagaagcagagaggttgtgggattccatatgatcaattaaccacttcattacatgtgattcccaactcgttgacaattggccacatcgagataatgacttaaccgccataataacaacattttctgggaaatgagcactggcaacataatatttcaattctttgaatatttctttaacgtttgattcatttattaacgtggacaaaatttggatcttccaaattgatgccacaataggatctttggggaaaacgtaaaatttcttggtgtagggtaaaaatagtgtctggtctaagatcgataagaagtgaattgcttgtaaaagcatttctttgttaccttggttttctgtcatggttaccgttctaaccaatgcttcaataaatttagtatttttcatctgcaatggtgaagctaactgatatagcgcattgcaacacgataaaatcactgtagggttggaactataaattaagcaattcaaactctgtagaaataaatctaaatcagggtcatttaccacctcgtaagatgggtattcaatctcgttgtatttatctggtaaaggacaactccttggggaaccttctgatgatttatcgaccacagttggttttggtaaatactgcttacagtacttgattagcagctcaattaaatatgattgtgaccacgaatctagttgcttaattattctacaatatctgcgaaaatgtccatgcaatagctccaagtgatccgcataacattctttgtaagctaggacagcacaggatatcaccttaggatctgtatctgccattaattctttcagaatatccaacaattcttcatgatagtcattctttccagccctatataatttgataatggccaaggcgacttcaccacgaaccattgcagatggatctgtaaccaatttcttgacagtatgcaaaattataggtgctaatgatgacattttcatgtcagaaagggcactcaaagcaaagcatctcagttcggaattcgaatcagacaatgatttttgaagagaattaatagataacagggtcaggtttgggtcattttctgcaaatctaagtaaatacaggtgaataagtcttttcactttggtgtcattagtggtgatattctttacaacatcagcaaagtataattgaacgtcaatagagtcatcatcggaagccattatagatattattctcttcattgcatctctaacttctctagagttcctagaatttaacaaggtgactaactgttgaggattgatgttttgagaataataagtataggaggattcacccagcttagaggtggctaccgcggcagcttccctcgttattactttggccgtatccaacgccgatgcaatacggtgaattgaatctaccattgctggttgtccacttttcgattgtttgctgtctttggtttacctttcttttctttatatatttatatatatggttcttcaaaaatgatttgtctgaatttgtcaaaatctcaataactcggacacgctttgatggtaacatacctaaaagttatgtacgttaatataaattatagatacatattatgtgcagcgatatacaggcagtacgctagcatttatattatcctagcatacttctcttacgaccacgcaacctgacctcttcgaatcttttggtaacttctttcagtttcttggcacctttcgcaccttgttcacgatagacctcttcgaacccctccatgatccaagcattgtatttttccgcatgcttcgaatgtgtacttaaaatagctctctctaagacgtataaatcgacgcctttatcttcgaccaggtttgaaactgagcccagaccgaaatcaatcaaatgaggcgtccatctcgcaccatctcgcacgagaacaatgttagaacttgtcaaatcaccatgacagtagtcattccagtgcaacaacccaatttggcgccccactttccgtagtgtagttgctacaagatcactatatggatcttggtcatgcatccaaaggaagttctttaggttactaaaaccgtgccctccgggaagatcttctccaaggaactctaaccaaatgaatccattgtatggatcacacgctatcagttgagggacacatagccctggaatcaagtataatttggccaataaacgcgactcattcaacgtacgatgttttgttagtgcctggtctatttgtggatgtctataacgctttggtggcctatatttgataatatacttttgatgagaatcctttgctcttgggagatatgggtgagtagtcgttgtgaaaacaatggcttctgcaccttgagaaataggtgcaatgtccacatcaggagtcaggtaggaagatactttatcaatgaattcttgcgtcataatgagcaaagcgtataaccttttccgctgtcgtattcatcacttatttgatttcaagtaaggttatctttgtccttcaagttggtgatgcgccggcgattttttcaaccttgttgctgctaaaataatggaaaatcaaaataaatttgtgctgacccaaatatttatgtatataaaaggggttatgtaattgtcattatgacaaattcaggattgcataaactcaagaatgcgagcgatagatggtatgttggtccagcgatccatattacgagagtagtttaatattgggcccgtatgataaccttggtgttcaaccagcacatttttggcggtaaagtggttacatccctcgctagcgtcactcattttctttgccaagatcttgttttgaaagctcaacaactcatcactaccataagtaatcatcacagagcactttttcagaatatcttgccacattttagtttcgaaattcttttcaatattaacaaaagggtcgctggtaaaatcgacgtttgggttgtttcctacaaacattcgcccaaacatcgaatgactcttcaaacatagaccatcccattcttgtgttccttgcatatattccttttctccctcgtggaagaaagtggcattggcccagggacttatggctatgacttttttcgggtatatttctctgtgacactttcttaaatataaaacaatgttcaaaacagcattgccaccagcagaatcccccataatcactacatttttgcaccccatagtcttaacaacgtaatcaaaaatggccacattttgtaaaatttgcagagggtactttttcgactggtcatcggtagctgtaacggtataatctggtacaagaatggccattttaggaaaggcatttcgcatattattcaagaaagaaaacgacgtaggcgtcaatttaagagcataaccacccccatgatagaatactaaaactggatctgtcgtggggtcaaatccttccggcataacatattgataaaactttgtgctaactattttgggtgcgtttaattgatggtcttggaaaatattgttttctggagatttctgatcttctataggaatgttgcatttgacatatgttggactagaaaatgtagaaggatataaacaaacaaataaaggattgagcacgtattgacagatgcgttcatcgaggatccaagaactttgtcttaaaaaacttctgttgacatggtcaaggcaaaacctacgtttgcgttgaaaaatgatcttcatactgtcgaggattataaatacaggcaccactgtgaacaatagagcggcaaatttcaatccatggaacaaatgcaaatggatggtactcaatcgaaagcccgcatcattttgatctgcatcctcacttgatacagcgctaataatttcattctcttgaagccgataatattcaacttttgagtcgagaccagagttggctgccattcttctttgaaaccttttcctttaaaattgatttgtgctgttctcatttcaagcgacgcagggtatttttggttttcagtttctttttccctcaattctatataattatggcgctaacacgttaaacatttgttattataaagcagaagttatttatcagaaatcaaatcatgaatattctcagcttaacactacacaattactcaactaaaagaaagggtataaacgtgttagcgggagaattgttttttaaacttgtttttatatcagagtaaaatctatatattaattgatacacttttatcatgtgaagattgaaagggaaaagagaggaaaaaaaatgcttccgatgaaccttacacttgttgaccaccatatttggctctccattcatcgattttcttttcatcaatacgttggaacaagtattctgccttgtttatattatgtccttctaggattgccaaatggaatctatcatcaatttttaaagctggtgcatttaacatcttgtttattttctcacctatttctggcatatatggtgtgataatagagctaacagcgtaaataatattcaaaccaactgcgacaacagcatctgacttttctggggactgtgaaaacaaggtattgtccaacttattttcttgcaaaaactggttaccacgagcacttaacgacatggcaatttctagaccacgtctttcatgtccaagttccatttccttgacgtaatttgataaaatttcgttgatatctttaactaaaccatcataattggaaaccttcttggggtcgaattttggaacaacaccattatatttggcattaacaaacttaattaatctgttaacaaagttacccaagttagccaacaattcactgttgtttctagcaacaaagtcatcccatgagaaatgagaatcactagattctggtctaacagatgccaggtagtatctccaaacacttggagaaattccagagtcttgagcgttattaccaaaaacaccaacacccctacttttagaaaatttaccgttctcatattgtaagtattctgtagtattcaaatggtgcaacatagtccagttctcttccgtacccaattgagaaccagggaaaacaactgtatggaaaggaacattgtccttacccatgaattgatacaatgaaacatgctctggattattccaccattgtttccattctttggtgtagttggaagtgatggaaacgtagccgattgtagcgtcaaaccaaacgtacaagactttgtctttatatttttctaaaggcactggcgtaccccaaactaaatctcttgtaatacaacgtggcttcaaaccatccttcaaccatgattgcgtaattgtttttgaattttttgaccagttaccttcttcagaggccttttcaacccattcagaaatttggctttctaatttatccagcgataggaaaatatgatcagaatattttggttctggagaagcatcatctaatttacaacgtggattgatcaattcaaatggatctaacagggcaccacatttgtcacattgatccccacgagcatcatcgtagtgacattttggacattcaccttccacgtaacgatcagccagataagaattatgaactggacagtacaattgcttcatagattgttcttctagataaccattcgaatttagctttgtaaaaatatgttgagcaatctccgtttgcttgtccgtcgtagttctaccgaaataatcaaatccaatttggaaccacttgtaaacgtcactgtggattttgtgatatttgtcacataattgtcttggtgtcacaccttcctccaaagctttagtttccgtggcagtaccatattcatcagtaccacaaataaacaaggcattataattacgtcccttacagtaacgagcaaaaatgtctgctgaaagaacactaccgatgatattacccaagtgtggaacgttgttgacataaggtaatgccgaagtgatcaagatgtttctttcgtttggcttaggcaaaatttctgaatcctttggcttaactgttaagtcagcttggattttcactgcgccgatgtttttgaaagaagaagaatcacgtggaacatgctttttagccaatgctacagcgttatgcactttggatggcaattctgggaatttagaatgaactaaagaagaatttagagcataaacgttagcaaacaggatcaaatctgtagtagtcaatggttcttttaattcgaccaagtaattttcaatggccttatttgtcaaaacctcgacatgttgttgaggtaattctttatgatataacaggttttgtaaagatgccaatgcaaattgatacttgtcggaagtttgaccttcaaaatcatccatgacatatcttagaatagcgttagcatcaaacaaaaggaaaggttcctttgtattgcgcaattccatggcagcattatcattgtcaacttcaggctttaaatttttgcttgcatattcaagtgctagggcaatcttcaaattgttcgctaactgcaaatgggcaggatgtttcttcgatttatcaaaggaaatgaggaaagacatgcttgttgtaaatttccgcttttttttcaagttttattcctccacaaagatgcatatcaggaagcaaatcatcattaacattagacatcgaagaaaatttgtcatcgtctttttttttttcgttttctctttcgataagttgcgtacagaaattttttctgcctccgaaatcattcgtgcctcgtgatattgagaagaagtgactatactcgggcaatgcataaatgatcgtttcggcggctaacaaagataatcatagcaagtcgacagatcgataggatacaccattatcatcacgctacgcgttctcgggaaagctttgactagaatatttttcaaagttgaattatattatgttaatcttttgacttcatgccttttgaattcccctccataggttcccatttttgacttcaacaattcctacttcaaaatccctggttaaagaagcctttcctcagtttgtacaactatgtccgctgtagctaaaaagttagcataattcatgttttatgcctgagacgttttaaactagtacttaatctctatcaataaacttaacccagaaggtctcaagattaaacatgttattttttcgtccttttattgaaaaaagttgaaatagcagcgtcgggtaataccaggaatatatttttatcggcacggctacatagcgaagggtccattagtaaaaatgaaaagaaattccacaaagttagtgaggggaaagtcctacagaaggtcaaaacagttgctaccgggttcaaagtactcaattgaaaataaacactgctacaaaaatgcatgctacaaactggttcgacgattggaacccagaagctctttatagagacgatgtcactggctgcgatgactgttccgaaacttcgccaattccaaagtctggtattatatgtggaccgatattaagactcatcaacatggattttaaggaaaaaacctacgaggggtctattatggtggtagttagaggcgaggaaaactttccgaaaattacctatcagctagggccctctttgccctctgaggatgaagacatcgaagttaacgaggcattcttcgaaggtaaactttttcataaggacattttaaaagatgataatatatggttttacaggtatgagattaagttgcccatgtccaactatgagcagatggtaaaatatgctgttgacggtactatggaaccacattataggttcttcgttccctctttcactcaaaattcgaacgttatctcctattcatgcaacggattttcactgagcgtagatacatcgaaattcaaaggttctctatggtatgatgtccttaaaaagcatcgatacgttcattatcatgccattctcggcggcggagatcaaatttactccgataatattaaactgcatgcgccaaatcttaaagcttggctggagacaaaggacccaattaagaagtataatactcagaccactgaagaaacaaaagagcagattaggcagttttatttagaacactatttaaactggtacggttacggtcactggtatggttctaccccaaaatccaagaccacccaaaaatgctttgtcaagtcactagcttgtattcctgccattaatgtctgggatgaccacgatattattgatggctatggatcgtacaacgattccttcatgaagactgaaaatttcctcacagtgggaagaatggcttaccgatactatatgcttttccagcagcatgtcagtgcttctaaacaagatggcgatgagtatgcttatctcaagagcaaacaatggattctaggtaatgaaaaagggagttcttatatcggtgaaaggtctcactcaatattctcttggttgggtccgaaaatggccatgttagggttggactgtagaactgagaggaaattacacgagattttctcagaaagaagttattccttaatttgggaacgtgtcgaaagggaaataaaaaatttaaaaggtggccacttattgctgatgctcggtatcccgattgcatatccaaggttagtatggttagaatggctttttacctcaaaactactggctccaattaaatatttatctaaaaaagggatatttgctagtggcttcgttaacgaatttaatggagatgtagaactgttggatgatttaaatgatcattggtgcgcgagacatcataaaaaagaaagaaactacttgataatgaaattgcaagacataggtgctaaatatggcgtcagaataaccatattatcaggcgatgtacatttggcatctgttgggagatttagggcaaaaattcatagacaccatctcatcatgtctgaggagaaggaaaaggaaaacaccagaattattgaagaaccaacgaaagacgtaaggctgatttttaatatcattgctagcgccatagtaaataccccaccgccagatgcaatggccacgctattgcaaaaaagatgtcgcttgcatcatttcgatttggaaacggatgaagatgccgtaccaatttttgccaaggaagtggatggagtacataaacgtaaagaatcatgtttcatgaacaagagaaactggtcagatattatacctatagaaaacctgttgaataatccccaattgagtaaagaattaggcgtaaaggttggtgatatagtcattcctggtatcatcacagaacagcaaaagctacagaaattggaaaacgatgaccaaattaactcttatccagtaacttctggtggcttgtttaccaccattcatgttgaaagagatgcaaatcaaacaaactcacaaactgtgagctactgtttacccattccagagttaacagttacctgcgaacggttgtctcacaagggtatcaaacatctgaatatcacatagtttagttttgtgataattacagatttttatttagcagttcaaacttttctattcattactaacggactgtcaagtgcgatgctgtaccggaagtaaatgtatatactgattgttgaaaaaaaaaaaagctcagtcgcgcgtggcctttctctatggagatttctcaaacgatattaatcctgtatatctctattaatttagttaatacatacacgatatatcgtcgcttttatttttttttttcaaatacttcttcttcctaaaagagttaaaaactcttctcttgttttatgagccctaaaccctccaagcatacaagaagttaccgtagaagatcccgttttttgaatgcctcttgaaaccatgcacatatgagaagcttccataacaacggctacacctaatggttttagaatatcacttagggccattgcaatttgctttgtaagtctttcttgaacttggagccttctcgcatacatttctgccaatctggccaacttacttaacccgatgacttttttatttggtatatacccgatatgaaccttgccgaaaaatggcaccaaatgatgttcacataacgagtaaatttcaatatcacgaacaataaccatttcatcatgatcttcttcaaagacagcattcttaatgacatcgtccataatgttcgtttggtaacctttagtgaaataaagcatggctttagcgtatctttgtggagtatctagtagaccttctctgttgacatcttcacccagttcggtcaaaattgtcttgatagcgcctgaaatgcgttgaattcgttccttttcctcctcttcagtttcctctgcacgttgtcttgtacccacacttggccaagaaaacccatctctctcgacaggagggtttaaagtgtatggagaggtaggtctaatgtttaacggggtttcatgtctttctatctcttgcactaattggatgttatgcattttgggatgattgaaagtattggttctaacaaaaaatgagtcacgcacgcacaatcacgattgaggatggagtcgtataatattttatgaacggatgctatatcgatcagacggttggcaccgtaaaaataaatgaaagaagttaaagaagggcaaatcagtcggattatgtgataagtatgtaatagacatgtttgaaaattaggagcattaaaatatgcttttcatcctacagttgttcggtcttttttcttttcggtgagcgacacagcttttctactaaggccgtaccgggtcatccaaatcctaaattttcatgcgctaatagcgttgaggctgggtgataattctgcctacaccatgacaaagaggacatatatcttcgtccaacaggaatctggtgcgtccggaccctctgcattcaccacatagcacgccacccaggcgaggatcccctggttgaacgtacaagggcctattaccctgccatgcgttggtgtacacgggcattgtatagtttgtgtaatatgtcggtgcagaaacaacgttattttgaggtgcaaacctcctccaacacgacttgcaagatcgtccattcttcaacttgtaacccgtatttccacacttggaacagtaaaacctgggagggtatgtccagggcaagctaggattctgttgtggcctcggtggaggccgtggttgggaacttgtaggcgtataagagtgtgagtgagcatatgtttgggatgaggacgttgctggcattgtcgagggcctttggtggggtcttgattggtgcccttgcgccaagttagctgctggtcttggtggtcgtggcggttgagattgcaatctctcctcttccttgattacgtcctcgtagctcggcagttcatcatcatgcgtgtctttagacataacagtatggtttatactcgttttatgggtattttttgggactgcttagttcttgacttgaagcctctttattcccttgatggaagtgtcactattaaagatggaggcggaggctataccgtagaaaatgatatgtttgtatgttctgctctcttccctctattaaaagggggaaagagaaaaataaatggaaaaaagcgattaagccatagggaaaacactcttgtggtggcaaagcatcagataggcaggcaggaggaaatggcagtgaagtgtcaaaccaagcatactttcactggattgatttgaaagttaatgctgagtttgagatgttttaaagaggaactgtggtgatcggttatttctattcgcttttgtgtgcgtcttttcatcgtttgcagctgaacttgttgaggcattagccgctgaggaatttttttctgcctctataaacttgtttattatcactaaaaacgtaccgtctgttattttgtacggccatgtgtgcgaaaaaggacaaagtggtagcgaaagagcaatattgggacgaaaaggagcagaaaaggaactgcgtagggtcttaaataaagcaaaacgtctgaaggatcttgcgtactccttactaacccattgttgttttcgacagtcataaaaagaagttaccacggtctatttctctcttctcgctatttattcacaattggtgcagaaagaacatggcacgaaatttaaggaatagacgcggtagcgacgttgaagatgcaagcaacgcaaaggttgggtatgaaacacagattaaagacgaaaatggcataatccatacaacaactcgctctttgagaaaaataaactacgcagaaattgagaaagtgtttgattttttggaagatgaccaggtcatggacaaagatgagacgcccgttgatgttactagtgatgaacatcataacaacaaccagaaaggcgatgatgaagacgatgatgttgatcttgtatcaccgcacgaaaacgccagaacgaacgaagagcttactaatgaaaggaacttgagaaaaagaaaagcgcatgatccagaagaagatgacgaaagttttcatgaggaagatgtcgacgatgatgaagaggaggaagaagcagacgaatttgaagatgagtatttggatgaagactcgaaggataacaaccgtcggcgcagagcggccgataggaaatttgtagtaccagaccctgatgacgatgaagaatacgatgaggatgacgaagaaggagacagaataagccattcggcttcttctaaacgtttgaaaagggcaaattctcgaagaacaagatcgtcacgtcacccagaaactccaccaccggtaagaagagctttaagaagtaggacaagacattcgcgtacttcaaatgaagaaaatgacgatgagaatgataatagcaggaatgaagcgttaactttagctgatgaaattagagagttacaggaagatagtcctatcagggaaaaaagatttcttcgcgaaagaactaagccggtaaattacaaattaccaccaccactaactgctagcaacgcagaagaatttatagataagaataacaatgcactttcttttcataacccatcacctgcacggcgtggtcgcggtggttggaatgctagtcaaaattctggtcccacaagaaggctttttcccactggtggaccttttggtggcaatgacgtaactacaatatttggtaagaatactaatttttacaaccaagtcccatctgcattcagtgataataacaacaataaattaatactggattcagactcttccgatgatgagatattacctcttggcgtgacaccgaaaacaaagaaagagaacacgcaaaaaaagaagaagaaaaaaccagaaattgcagacctcgatccattaggcgtagacatgaatgtaaattttgacgatataggtggtttagacaactacattgaccaattaaaggaaatggtggccttaccactattatacccagaattgtatcaaaattttaatatcacgcccccaaggggtgttcttttccatggtcctcctggtacgggtaaaacacttatggcaagagcgttagcagcaagttgttcttctgatgaaaggaagatcacattttttatgcgtaaaggtgcagatattttatccaagtgggttggtgaagctgaaagacaactccgtttgttattcgaagaagctaaaaaacatcaaccttccatcattttttttgatgaaatcgacggattagcgcctgtgagaagttccaaacaagaacagatccatgctagtattgtttccacattattagcgctgatggatggtatggacaatagaggccaagtcattgtcatcggagccacaaatcgacccgatgcagtggatcccgcattaagaaggccgggaagatttgatagagaattttattttccattacctgatgttaaagcacgttttaaaattttgcaaattcagaccaggaaatggagttcaccgttgtcaaccaacttcattgataaattggcttttttgaccaaaggatatggtggtgctgatctgaggtccctatgcactgaggctgcactaataagtatacaaagaagctttcctcaaatttataggtcaaatgataaactcttggtggacccttctaagattaaagtcaaagttagcgatttcatgttagctttgaaaaaaattgttccgtcatctgcgagatctactggtagttctcctcagccactacctgaattaatcaaaccattactggcagatcaacttaataatttaaagaacaagctggattatatgctgaacattaaagacacaacttttcagagaaacacatcattgctacaaaatttcatcgattatgaagaatacagtggagaggaagaagagcatgacaaatatggaggaaatgaagatacatccagttttagatcatatgagtttttcgaatcgatggcggaatcacaaatttgtaaacctcggttattaataaatgggcccaagggaaatggtcaacaatatgtcggagccgcaattttaaattatttagaagaattcaacgtccaaaacctggaccttgcctctttggtttcggaaagttctaggactattgaagctgctgtagtgcaaagttttatggaagcaaagaaaagacagccctcagttgtatttattcctaatttagacatttggatcaacactattccagaaaacgttattttagtcttatcaggtttgttcagatctttacaaagcaatgaaaaaattcttctattatgcttagctgaaaatcttgatatatctgaagttaaaaatggtattttatctgattttgcttttgataaaaatatctttcaactgcataaaccatccaaagagaatataacgaggtatttttctaatttaattgaactactgaaaacaaagccaagtgatattcccatgaaaaagagaagagtcaaaccgttacctgaattacaaaaagtaacttcaaacgcagctccaacaaattttgatgaaaatggtgagccactgtctgaaaaagtggtattaagaaggaagttgaaatcttttcaacaccaagatatgagattgaaaaatgtgttaaaaatcaaactctcaggcttgatggatctttttaaaaacagatataaaaggtttagaaaaccacctattgatgatgccttcttggttcatcttttcgaaccagagacaagcaatgatcccaattggcaacctgcatatataaaagatgagaacatgattctggaggtttcaacagggcgaaagttttttaacatggatttggatattgtcgaagagagactttggaatggctattactcagaaccaaaacagtttttaaaagacattgaactgatatacagggatgcaaataccattggggacagagaacgtgtcattaaggcctctgagatgtttgccaacgcgcaaatgggtatcgaagaaatttcaaccccggattttattcaagagtgtaaagctactcgccaaagggatttggaaaggcaggaacttttcttagaagatgaagagaaaagagctgcaatggaattagaagccaaagaacagagtcaagaaaatatactgcaagaacctgatttaaaggataacaaggctaatgagtttggtgtagctgctggtaatcaattgcaagctcagctgcaaacaactatcaatacagcctctatcgttaataacagcgaggtccctcaaccaattgataccaacctgtataaaaaggagattcctgcggcaattccctctgcagtagataaagaaaaagcggtcatccctgaggatagcggtgcaaatgaagaatacacaacggaactgatacaggccacttgcacgtcagagataaccaccgatgatgatgaaagggccagaaaagaaccaaaagagaatgaagactctttgcaaacgcaggttacggaagaaaacttcagcaaaatagacgctaatactaataatataaatcacgtaaaggaaattcaatcggttaacaaaccaaattccctccacgaaacggtagaaaaaagggaacgaagtccgataccaaaagaggttgtggaaccggagcaagggaagaagagcgacaaggagcttattttgacgcccgaacaaataaaaaaagtatctgcatgcttaatcgaacactgtcagaattttacggtttctcaattagaagatgttcattcgtccgttgcaaaaataatatggaaaagtaaatcagcatgggataaaacaggaactgtcgatgaaataataaaatttttatctgaataagcaggagtccataatgtttatataattcttaaatgtagttagttcatatacatgaatgtgcacttttcttgaaaagaaatagatttaaaaccacaccttgtatatatattatgcttttttccactactttattttaacagtcactgttctggcatacgtttcgggtaatgaccgagaatggaatatgtattgaacatattgaaattaaacatgttcataatatcttctaacaccattggaattgtgagaagtagatccgtaccatcaatagccggctcaagatgtcaactgaatactctgctgattcatctaaatcatttatgattgcaatgcaatctatgattgatacttcacaaacctttaatctagatagatcgaaaatctctttaccagattttgatgacgagctaaaaaaagtccaaaaggatgaacaaaatcaaagaactgaactaactgttctctcacaagatagaaatgattgggatgatatatttgaggagtttaaagacatttcatttgctcaactgcaatctataattgattcatacaaaacaaagaatgcagttgcagtatataaaaaaattggaaaactaatcaatgaagctgaaacgacactaagcagcaatgtattattagaaactgtactgcaaatggtttataaacatcaaaagcaagagttagagaaagaattgttggattttttaggaacagggaatatagaccttgtttctctgttacttcagcatagaagaatgatcgttgctacacctatagaaacgacgattctgctaataaaaaatgcggtcaattcaacgccagagttcctgacacagcaagatatcaggaatcaagttttgaaaagtgcagaggatgccaagaataggaaattaaatcccgccactaaaataatcaagtacccacacgtcttcagaaaatatgaagcaggatccactacagctatggcctttgccggtcaaaaattcactttgccagtagggactacaaggatgtcgtacaatacccatgaagaaattataattccggcagcagatcaggcatccaacaagaactatctctatacaaaactattgaaaataagtgatttggatcatttttgcaagactgtatttccctatgaaactttaaaccaaatacaatcccttgtttaccccgtagcttataaaacaaatgaaaatatgctaatttgtgcacctactggtgcaggtaaaacagacattgcattactgacaataattaatacaataaaacaattctccgtggtcaacggggaaaatgaaattgatattcaatatgatgattttaaagttatttatgttgcccctttgaaagcactcgctgctgaaatcgtcgacaagtttagtaagaaattggcgccttttaatatacaagtaagggagttaacaggcgatatgcaattgacaaaggcggaaattttagccactcaagtaatagtcacaacccctgagaaatgggacgttgtcacccgtaaagcaaacggcgacaacgatttggtttcaaaggtcaaattactaattattgatgaagttcatttactgcacgaagatagaggttcggttattgaaactttagttgcacgtaccttgagacaggtagaaagctctcaatcaatgattcgtattatcggtctatcagctacattacccaattttatggatgtagcagatttcttaggagtaaatagacagatcggaatgttctattttgatcaatcattccgtccaaagcctctagagcagcaacttttgggctgtagaggtaaggcaggtagtagacaaagtaaagagaatatcgataaagtcgcttacgacaaattgagtgaaatgattcaaagagggtaccaggtaatggtatttgtccactcaagaaaggaaactgttaaaagtgcaagaaactttatcaaactagcagaatctaaccacgaagttgacctttttgcacctgaccctatcgaaaaggataaatattctagaagtttagtgaagaacagagacaaggatatgaaggagatttttcaatttggttttggtatccatcatgctggtatggcccgttcagatagaaatcttactgaaaaaatgtttaaagacggtgctatcaaggtactgtgttgtactgcaacattagcatggggtgttaatttacctgctgattgtgttatcatcaagggtacacaagtatatgattctaaaaagggtggattcatagatctaggtatttcagatgttattcagatttttggcaggggtggtaggccgggcttcggttccgcaaatggtacgggtattttatgtacttccaatgatcgtctggatcattatgtttccttaattactcaacaacaccctatcgaatctagattcggttccaagttggttgataacctgaacgccgaaatttcattggggagcgtgacaaatgtagatgaagcaatcgaatggcttggttacacatacatgtttgttcgtatgagaaaaaatccttttacttacggtattgattgggaggaaattgcaaatgacccgcaattatatgaacggaggagaaaaatgatcgtagtagctgcaaggcgattacatgctctccaaatgattgtgttcgatgaagtgtcaatgcatttcattgcaaaggatttgggcagggtgtcctctgatttttatcttttgaacgaatccgtcgagatattcaatcaaatgtgtgatcccagagccaccgaagctgatgtattgtccatgatcagtatgagcagtgaatttgacggtataaaatttagagaagaagaatccaaggagttgaagagactttctgatgaatctgttgagtgccagattggaagccaacttgacacccctcaaggtaaagcaaacgtgctattacaggcttatatttcccagactagaatttttgactcagcactatcatccgattcgaattatgttgctcagaactctgttagaatttgtagagcattgtttttaataggtgtcaatagaagatggggtaaattttcaaacgtcatgctaaatatttgcaaatctattgaaaagaggctctgggcctttgatcaccctctctgtcagtttgatttgcctgaaaatattatcagacgcatcagagatactaaaccttccatggagcatcttttagaattagaggcagatgagctcggagagctggtgcataataagaaggccgggtctaggttatataaaatattgagccgatttccaaagattaatatagaagctgagattttccccattacaacaaatgtaatgaggatacatattgcattaggtccagactttgtatgggattcccggatacatggtgatgcacagtttttttgggttttcgttgaagaatctgataagtcgcaaatccttcattttgaaaagttcatcttaaacagaaggcagttgaataatcagcatgaaatggacttcatgatcccattgtcagaccctttgcctccgcaggttgtcgtaaaggttgtgtcggatacttggattggctgtgaatcgacccatgccatctcttttcaacatttaatcagaccatttaacgaaactttacagacaaaattgttgaagttacgtcctctacctacatcagccctccagaatcctttaattgagtcaatttatcctttcaagtatttcaatcccatgcaaactatgacattttatacactttacaataccaatgagaatgcgtttgttggctcgcctacaggttctggtaaaacgattgtggctgaattggctatatggcatgccttcaaaacatttcctgggaaaaagattgtttatatcgcaccaatgaaagcattagtacgtgaaagggttgatgactggagaaagaaaataacaccagtgaccggagataaagttgtagagttaaccggtgattctttgccagatcctaaagatgtgcatgatgccaccattgttattacaactccagaaaagtttgatggtatttcccgtaattggcaaactcgtaagtttgttcaagatgtatctttaattatcatggatgaaattcatttgttggctagtgatcgtggtcctatcttagaaatgattgttagtcgtatgaattatatttcctctcaaaccaagcaaccggtcagactgctaggtatgtcaactgctgtttcaaacgcctacgacatggctggctggttgggagttaaggaccacggactgtataacttcccgtcaagcgtccgtccggttccattgaaaatgtacattgatggatttccagataatttggcattctgtcctctgatgaaaacaatgaacaaacctgtgtttatggccattaaacaacattcacctgataaaccagcattaatatttgttgcatcgcgtagacaaactagactaacggctttagacttgatccacttatgtggaatggaagataatccacgtaggtttttgaatatagacgatgaggaggaactgcaatattacttatcacaggtcactgacgacactttaaagttatcactccagttcggtattggattgcatcatgcaggtctagtgcaaaaagatcgttctatttctcatcagttgtttcaaaaaaacaaaattcagattctgatcgctacatcaaccctagcgtggggtgtcaatttgccagctcacttggttatcatcaaaggtacacaattttttgatgcaaaaattgaaggatatagagatatggatttaacagatatcttgcaaatgatggggagagctggtagaccggcttatgacactacaggtactgctatcgtttatacaaaagagtccaaaaaaatgttttataaacatttcctaaacgttggttttcctgtcgagtcctccttgcacaaggtattagatgatcatttaggtgcagaaataacgtcaggtagcataactaataagcaagaagcgttagattttttgagttggacatttttgtttcgtagagcgcatcataacccgacatattatggcattgaagatgatacaagtacagcaggagtcagtgaacatttgagttctttgatagatagcacattagaaaatctgcgagaatcacaatgtgttttattacatggagatgatattgttgctacgccattcttaagtatatcctcatactactatatttcacatttaacgatacgccaattattgaaacagatacatgatcatgcgacttttcaagaggtattacgatggttatcgttggctgttgagtataatgaattgcctgtaagaggtggtgaaattatcatgaatgaagaaatgtcgcagcaatcgaggtactccgttgaaagcacttttaccgatgaattcgaattaccgatgtgggatccacatgtaaaaacatttttattacttcaagctcatttaagccgtgtagatttaccgattgcagattatatccaggataccgtatcagttttggatcaatctctacgtattctacaggcttatattgatgtcgccagtgaattgggttactttcatacggtattgaccatgataaagatgatgcaatgcataaagcaagggtattggtatgaagacgatcctgttagtgtacttccaggattacaactgagaagaatcaaagattacacttttagcgagcaggggttcattgaaatgacgccgcagcaaaagaagaaaaagctgttaaccttggaggaaataggaaggtttggatataagaaattattaaatgtttttgatcaactaacttttggaatgacagaaagcgaagatacgaaaaaacgtttcgtcagtgtctgccaaagattaccggttttagaaggcatgaaatttgaagaacaggaaaataacgaggtgttaacattttatagcaagcacctttctagtaagcataataatgggtttgaagtatattgtgataaattccctaagatacaaaaagaactatggtttttaattggacacaaaggcgatgaactgctgatgattaaaaggtgtcaaccaaaacaaatgaataaagaggtcataatacattgtgatctatttattcccgaagaaattcgtggcgaagaattgcaattttcccttattaatgacgctttaggattacgttatgatatggtccataaactaatctcttagtgagacacaattaaaacaacaattattttgtgaaagataacagtggaaatctatctagtatacatcttcgtatatattttcttacataacgcatttagaatttttttactcaaaaaagtcatccttttcatcttctcccacaacttgatccaattcttttctatcctgtgtaggtgatacttgtgatccatcctcatgatctttatcaggtgataatgttaatccgatggaatcttcatccaatttctttcccttcaatatctcttcgaaagatacgtttaaggtgttcgcatccattctttcagctactaatttaagaaattgttctcttctaagatttgtcaattctacgccctttgggtctgtagatggtgtatcattcggatatagtgcaatatacttttcagttttgggaaaatttatcacgtaacataattcaattttagtggctctcaacttttgttgtaaatctttatcatctgcgccagattcttttattttcttcaataatctgttatattttctcaatgctttttttttttcaaagaatctcaccatatgatattttttagcgttggctttaatcttattcttgagttcattattctgcaattccaaccgtaaagcttgcaaatttctttccttttctattattactgtggatggaagtatatctttcttcttttttaataacctctctaaatctcttattcttcttttaattttgtttgttcctgcatccattatctgggacatctctagagatgacccaagagccttgcttctcttcctctgtaatttagccattgattgattaggtttattgaatgatataagtaaaataactaagtcacgatatttgttttatgtattgtttaattgtagagatgagatgagtatgaaaatttttttgaatgtgtttttcttagtgctccggcatagggtaccgcagaaattaaaggaatacatatttttgagcttcaagcactttttataatcttagcgtacttatctttatattcatctgcagagtaaccgagaaagccgtgatatgtgtcttttctccttttttttttggctttccataactttttcttccagttgagataaatttattgaagcctgtgagtcttgattaatgacggcaaatccaggtctaggtttaaatcccaacttagatgtttctagctcttgcaaccagcggggatcttttgttatggagtattcaaatccacgtattgtatccaatggcctttcatttcttgctcttgtaggatttgaaatatcaggtgtttttatattcctaccaaatgtatccttcatggatttcaaatttccatctttatcgtaaataacataaccattgcaagttgagttttctgttaacggatgtatcttctgtaagttagagaaagtggcttcttcaaaaggctgggcttcttgaacagcctcgaggattggagcggccaaagaagaagagcgtaatttaattcttgatgtatcatcatccttttctatcttatctgaactttcgaaatgttgcattttttgataaactatgattttagagcacttcagatattactttaggaaacttttgctttaatattcttaacattataaaattgacgacagcatcacacttttgagtgcgtcacaaatgcatataaatgaaaaaaggtaacttagttgaggaaaaaatagacacaaattaaaattttgatataattatagtaataaaactacataaatcatattatatttatcaagacaaacaggttactatagggaaaaagattaaattttgagtaagaatttgcttttgtaaaggaaaagagcaaccagtatgaaaaatgcatattagggaaccttttctgctattgtcctttatgttttaacctctgtgatttccaatcagactggaaaaatacaagctttaaatactcgagcacaaagacaacaattattgtgtttaatcagtgagttgggctatattaatggaactcaaataatatgcacttttcatcttactgcaaaagtgcacattcacacaccacgtccatcgtttaaggatatgactcaataaattatcaatctgatcactgccagtgtttagaaacatagtgtacatttctttattgttacattatacaaaacctttacaaaagttttattcgatcaatacatcgttatactgaatctactttggtgaagcagggttatctttactgctatacattggacaagatttatttgttctaatgtgcccgatttgtccgcatgtagcacatctccttgtagtgttcttacctttattcctggctgctttcccgtcagttacaccggcaaggtcgctaccattatccacagagttttctgttctcgtggcaccaccatttctcttcgaattttgccttgctgctctacgttgctgtgatttttccaaattagctaattctagttgcaacagttttttctgtttctcaagttcttccaagttatttatctttgaagtgtcctcctctaacaatttgttaacatcttctttatcctgttctttgatttttatatatccttgaatgaccctaggatctcttatgaaaattgtctgcctttgaattataccattttcatctcttttctttctaacaatcttcagaattttcttatcatctctatccgtcttaacatgcttgttggtctgattaatctcatcaggattggtcatttcctcaaaaggattgcttatgctcaacgattttgtatgtgtataccaggtcttcgcaatttcttcgtcgtaagctttttgctgttgagccacattgtagctatgcgtgttagtgccttttttgtttgaactattgttattactggaaggagaaccagacttaacaaaaccacctttcattgaagttttcaagaaagaaaaaccttcaccacagcccgttgggtcaccaacaccatgtatttgtatcatagctcgcatttgtgttgaattaataaaattttttgtaatgttccatggtaacaagttttcttctagagattttagcttagaatcaaaattatatgcttcattatcttcttggaattgtaagccctgactcattgattcaacttggctgatctgctctggcgtaattaaacttttcactgcttcattgtctaacaatttttcatcatctttaagcctccacagacctttttcaggaccatctctttgatatttcatgaactccttcactttttgtctgttttgtccataatcttggtcgggaaagtgctttgcaatgggatcaatagaaattgccttgctgtgattatggtttagaattctataaataatcattttcagtcttgtagctttcattgatgtcacctttcttgaattaggtccgggaatctcctcgacaggaaaagtttgtccaaccgtaaaaagatggttaatattacgtaagtaaaatcgattgcttataccaaatccggaactttttgtcagaagaaaatctgttcctgatatatcatgtttgaaaacgggtgctctaatcatgttattgtataatgtggggacgatatgaccaggttcaacaaatccaaagttccaaaatggtgatttgtcttgaactcccaaaacgtgagtttcgccaacaggcaatttgggccttagagtatcttgttcattggctttccgataataattaattaatttattggccataccaaatttagacaaagctaccggtgtttgttcagaatattccattaaataaacaggagcagtatccccgatggttagatcttgagatgtagaaaatgattctttgacatctttacctttatctcttttccttttacgcgcttttaacttactgaagacaattttagtacctggtctgatgtgcgaaccaaagttttcacggtggaaatgcctcaactggtatctaggaacagccactttgtaaaatggagattgtaaattaatcgcaggttgagaatgctgaatatttaagttcgagatggtagaacgaacttttgtttgatgggtttttttcaagatttgatatttatcatcattagataaattgaatttttgttgcaaaatagtttcgttgaggggcaatatcaagttactactatccagttgttgcttttgctgcgctaaattatttgttttctcaatcatcagcaacagtttttcgtcattcatatttaattcagcatgtttagactctttcaattttgcatcaatgatcatgtcttcatcccactgccaatcttcagcaacatcctcaatcaagctcttcaatttataaccgccggagaactttaagttgggtgtcatagacgaatccgccaaggttgctgttgatgaagtaccttggttgatgattttttcttggtcccaatcatcagtggcaataagcaagtcttccgatatggtcttttcatcatgaataatctttctttttttttgttgctctttgatagggaaaagttcatcaatggaaacatgaattaaacctcttcgggatgcagaagagttactttgaagtaaattgtttttcccttgataaatcggagcgacgtaagatattgtccttgagttgaatagcctcttatcatcctgttgaaccttgaatttcaaatttaaaggcataaacggtttctttaccctagatatttcactgtgccaatgataaggaacagatcttctataaatcagcttgttccattttaaaattttacccttttcaaaatcaggaaagtatttttttagaagatacttctcatggtttatcaagtctaatttggtggctttcttatgcttgccatctgacatatctggttccatgataaatccaccatttatcgacatatcatttccattaacgccaccaatggaaagttgagaatgcccaatttcatttgcgccactaccatcaagaactccagtttcagtggcgagatgaatttcatttgcatccattcccataaacaaagcattgctagttgcgggagtacccccatcatcctccaaaataaactgttgagacaaatcaccattaatttcaggcagttgcatattcaaactatttgagtcgataccgagtacggcaccgttctcgtttacatcatcatacgcgcccatagtcatcatagctggatgcaaattagcatcagattcttctggcaaatcgtcatcgtcatcagcaagttcatcttcatcttcaaaatctacagcatccggcaaatgctccgtatagtcctttgaattggcaccttcatccccgccaatgtatgacccgatttctaaagagccaaactctccgccaaaaatagcttcatatgcttcatcttcgttggccaagttggtcttgccggatccctgctgctttaccatatcgccttatactcctgttgtacttctttttctctctgtgtttaaaatgctatttattctcttaaaagcacatttgaaaaccatcgccgcgaaatgaaattatcgactagtttattaatgaacaaggcgataaaacctaatgttggaaagaaagagctacgtcagcaagagatagagaaaatggacccacagacgctcattactaaggccaataaggtttcttactatggcaaccctacgagtaaggaatcatggaggtatgattggtaccaaccatctaaggtgagctccaatgtgcagcaaccacaacaacagctaggggacatggagaataacttggagaaatatccattcaggtataaaacatggttgaggaaccaggaagatgagaaaaatctacagagggagagctgtgaggatatattagatttgaaagaatttgatagaagaatactgaaaaagtcgttgatgacatcgcacactaagggtgatacaagtaaggccaccggtgctccttctgctaatcaaggagatgaagctcttagtgtggatgatataagaggcgctgtcggtaatagtgaagccattcctgggttatctgcgggagtgaacaatgataatacaaaggagagtaaagatgtgaaaatgaattaaaaggaaaagtattatgcatatatatatatatatatatatatatatattatatattattnnnnnnnnnnnnnnnnnnnnatatatatatatatatatatatatatatatttatatatttatacacatagaattattttacagtaaaggatgctacaccaccccgggctaactttatggcttctactatttcaggttccctttcgcgtcttttatctaatctttcctttttgtcttgaataaactctaactcagttgaaagattgttccatggtcttgtgtcgcctgtacccgacatgatcaaaatcatagtacctggtgtagcattctcgtataattgtgttagatgttgccctatatcatgaagaaccatggacgcatcgaacgaaggagtttccttccgtggctttttattatagttgcgtgacctctctaagttcttgattctccccacaataagtttgacatctttatttagattctcgtgaatatgggtccatgtctcatcatcttcgacgcaacggattaactggcccttagaatcgtcctcagtatgatttttaataatcatatcgttgagaagaacggttttcacttcaaaacgatgtaatttggtgaacaagttctccgtattgatacctatcccaaatgctaacccatttaagatttttaatttcgtcaattcaagacaagcccttgcatcttcgacagaatcgtgttctccgttttgaatgcttttattcagaaaggtttcgctcaagtattttaaacttggcttgaaaggatcgccagctttatgatggtatataatagctgtatccacgaccaatggatgtttcaatttcatgactttcaaatcattctgtagcgaatgtcctatcaaaatatctgaacgacttattatctttagtaaatctttttgtacttctcgcaatgttttcttggcaccaacagttagtttctcttcagttataccactgtaacgtgtcaaatagtccactatggggacatcaggtttcaccaactcttcatagataacttcattgtcaaaattcactagagaaatcctagttagaactaaaccttgttcggaaagacacatttcacagtctagtgcaaagatgtgggagccaccatgggtaaagtcaacagtttgtacccagtctgtatcaaaattggtgtctccagaatccagtgggtaatcgtttgccactaactgttgttcggatagaaccaaatcgttaatagtaattttcttcttcttttgtaactctttcaatttatttattttctccattttggacaatccaacattaataaatgaattgtagggcgaaaagagcgtcatcttggaaccaggtgccatcacgggaaatgtatgaaacgtggaggcaatttctccaggaatatatttgaagttatcatcactgatttcattaaaggtattttttccgttctcaaaatcatctggttgtaaacctggaatgaacagaactatcattttctgtaaacttgacctgttacaaatatcaatccatttgggagagttgttttcagcctgcaacaagtattgagtcatgtctcttacatcctttataccaatacctttttcaaccacagactttagcaatgtgcatgtcataggctttgccttttttttcttcttattcttattcacttccgataccacatttgtatgatcatcctcttgtacagaagtcttggataaccttcttttctttgatcccaaagccaaatcactcacgaagttagtgtcaggcccttctacttgcatgtttgcctgagtatagtctattattgttttcttcctcagtcatccttggtattgccatcgagcaaaaatcttccctccatttctattgtgtcctcgcgccacttataaaatactaacaataaaataatagtgaactacaacaataaaatatacaaaaatatgtttatacgcaagggttttgtggagtgcacgttggcgaagcagaggacttaagtaggcgtctgatttccgtgctgcttaacttctcgctccagccgtcttcctcccttcctccaagtacattaaccacatgtactgccaatgggctcatgcctttttcaatcctagtcttattcacagtctctgccccactgacggtttctctactcacaactaaacattctatctcgggtactttccctgtggggccgcacacgtcccttaagggaactagttctacggagagatccggttttaacaacttgatgaattgatgtacgtgcctgcatcgtgtatcataaggttcaatcaactctttgtatttcttgttttgcaagagctcatcgcacgtaattccacaaattaacctttgtgacgtgatgaatgtagagacgctcaacaatattttatgtccatcgtgaatgtggtcgaacgttccgcccaatgcggtgacatgaaatttgttagcatctttgggaccttctatctcttccattatattatcgtgtaatgcataatgttctatactatggtattgtccttgtcccaactctagcttccaagtttcaaaagtggattcctgtggcaataaaaccactttccattgcaaattactctcgacgaaatgaatattgttgaatatgatgttgattccgctgttgatcattccatagcccaaaaggacatccctggtaatactgtacatcttccctagcgcagaatccaactggaatgaggttttgaattcaggtacaatcacgatgtctagttgactttgacattctcttaagaacggaatagtttgccctataatcctctgcaaagtagcactaggcggtgtataaggaagaacaatcaaaactctggaattttcctcaaccatcttacacttctttactttagatttttaggtttaatcacgtctctttttatgacggtccttatttttatctttttccattacgtactcttgaaaaattatattacactgatatttattttggcattgtgagtaagaaacctaaaaaggaataaaaaggctacaaaccagcatgtctaccgctaccatacaggatgaagacattaaatttcagagagaaaactgggaaatgataaggtcacacgtttcacccataatatccaatttaacaatggacaacttacaggaatcgcacagagacttatttcaagtcaatatacttattggccgcaacataatttgtaaaaatgttgtggattttactctgaacaaacagaatggcaggctaatccctgctttatccgctttgattgccttgctaaattctgatattccagatattggagaaactttagcaaaagaactaatgttaatgttcgtgcagcaattcaatcgcaaagattacgtgtcctgcggaaatatccttcaatgtctgtccattttatttctttatgatgtaattcatgaaatcgtgatcttacagattctattgctactccttgaaaagaattctttacgactggtcattgccgtgatgaaaatatgtggctggaaacttgcacttgtcagtaagaaaacccatgatatgatttgggagaagttaagatatattttgcaaacacaggagttatctagtacactacgtgagtcgttagagactctgtttgaaataaggcaaaaagattataaatctgggtctcaaggtctgtttatattggacccaactagttacacagttcatacgcactcctatattgttagtgatgaggatgaagccaacaaagaactgggaaattttgaaaagtgtgaaaatttcaatgaactaaccatggcgtttgatacgctacgacagaagctgctgataaataatacgtccgacacaaatgaaggtagtaacagtcaattacaaatctatgacatgacatctaccaatgatgtcgagtttaaaaagaagatttatttggttctgaaaagttcattatcaggtgacgaagcggctcacaaattgctaaaattaaagattgcgaacaatttgaaaaaaagcgtggtagatataatcatcaaatctagtttgcaggaatctacattctctaaattttattctattttgtccgaacgtatgataacgttccacaggagttggcagacagcttacaatgaaacttttgagcagaattatacacaagatatcgaagattatgaaactgaccaactgcgaatcttaggtaagttttggggacacttaatatcttatgaatttcttccaatggactgtcttaagataattaagttaactgaggaagaatcgtgtcctcaaggaagaattttcatcaaatttttatttcaagagctcgtaaatgagctcggattagatgagctgcaattaaggctaaactccagcaagcttgacggaatgtttccgctggaaggagacgccgaacatataagatactccataaatttctttactgccataggattgggcctgctcacagaggacatgagaagccggttgacaattattcaagaagttgaggatgcagaggaagaagaaaaaaaattgagagaagaggaggaacttgaaaagttacggaagaaggccagagagtcacaaccaacccaagggccaaaaattcacgaatccaggttatttttacagaaggacaccagagaaaatagtagatcaagatcgccattcacagtggaaacaagaaaacgtgctagatccagaactccaccaagaggatcgagaaaccatcgtaacagatccaggactccgcctgcaagaaggcaacggcatagatgaagagcccggccaaacaaacattacacatgtaatcgtacatatttacatagaaccgtacacgcttttagccaaaaaaaaagaaaggtagaatataaaataaaaactcgtatttcgtattaagacaaatatacagaaatacaaatgagatcataaacgaactaaaataggaaaatagaaaaaaaaaaagattagcgaaggcaaaccagaaagcagtcctttgatataacagagaaaaagaagattatcaaagccttaatttaaagttaaaaatattgggtatcgttttttaaatcaagatttttttgttttttttacaattgagtagacttattcattggatagaataccccagtatttttcaacaccgtaagcaccgtcggccttccagtagtcgttgaaggcagtgaataagaaggtatcagcaccacaggagctggtaatggcggaaacagcgtccttttgattttccttagatggaacagcaacaccgtaagtctcaccctttgatggccaaccagactcagtgataacaacattcttcttaccatcacaagcagtccagactctttggatttgttctagtaaccatttaccggagtcttgggcaactgtgttcttgtcaaagtaagcatgggcattaacagccatgtagtcggagtagtcacacaattcagggttgttgatcacagcaataaaagtatcaacagaaacaactggaccagtgtaaccggcagccttcaaggcagatctaccagagtcaatgtattgaccgacttgggatggggtagcttggttaccgttaaccaattcgttaccaatggaaacagtggtgacatcgtcccaagaaccgtaagattcaacagcagacttgatggtgttgacaccgtcttggatttggtcaacgtagtaaatacctaaaaagactttttggttcgaagccttagccttgaaaacattttcaacttggttacagtcggtaccgtacaatctaatgactgggaagtcagtcaattgagctaaatcggaagcaacttccgaagcggatttacaagcaccgctggactcgtatggggtataagtgatacctctgacaccagaggcaaagctgctgacgtcttcgccggaagaactagaggaagaagcttgggaggaagaggaagattgagtagatgtagcagcagagctggaggctggagatgcggcagcagaaacttgtgagttgttctcagaagaggaagcagcagcggtagctacagaagcagcagacgatgttgtactggtagcggcagctggagcggagttgacaacagcattttcttccaaagcagcaactggagttgaagcggcaccattaacaatgatagtggtttgtttttgaacagtggtagtgaccacagcacgcttgtccttgtgttcgtggttagcgggagcagcaagagtagcagcagataaaagagaggcagaagcaattaggttagagagacgcatatttttctagtttgcttttcggtatggcttgctagtatataaacgattgtagatgtaaaagaatgacttagttggatttagttagatatctagctggacctttgtgtaaacactattaaaagaatagaataagggctaaaagaactactaaacagaaaacaattatgacagaagataaagaatacatatctattagttttataaaacagagatcttctcctcgaggaatgggagaaaacagaaaaaaaaaaacaaaaacaacggtgccgtttttgaaacaacaccacaagagaaaatttctgaaaaaaatgcgcgtgaaaaggaatcatgtgcctattttcctcatttggagaggctaaacgaaaagggaaaagaggtgcgttgcgcgtgtttctagggagaagatcctattgcagcagggtgtcgcgcgaaaagcggtgcctacaaattacaaaaccctctgggaaatgaccgtgcagggtcgtttgtggatgcatctcgattaggccgggctaggcatcttgattctttcccaaaatggagttaacgagctcgattgggcgttaattgatggatttggttacactgatacgaattgagcccgtttatcattcatgcagcggctttatggagggtgtggaagacgttagcgatgttatgctttccacttgctctactatcttccatcaaacccacctaataaagctgaaggttttgcaggggcagaagtcgtggcgcaataagttcaataaatacttataatattacttactagtttaatcatgtatgtaaaaactcgttgcggtatgctgtcgtactggcacacatttttttttttcatttttatttgcttttttctttggcaccggggaagaatttttccccactctatatatcttgctgcgtgtgcagactggccagctgctcacacaatgaaacgcaatggaatgtttagtcgtttgttatcataaagatctcattcagtgccttggagtccatcaacgcggccctcttttgttttatccatttggagcgcaccgatagtcttgtgtttaccgcatcggggatattggatgcagattcactagattttaattttgacgtctttttcgtttctttggtcttttccgcccttttttccttcttcaatctcttctcttcctttttatgtttcttatgctcctttttgtccttcttgtcttttttcttgtctttcttatgctttttgtgcttcttgtgcttctttttatcactgtctttatcctctttgtcgtcatcatcttcatcttcgctatcgtctccttccctctttcgtttcttcgcgttggagtaatttcttaacttgtgagtctttggatcccacgtgcttgctaaaacttcacccttcacaaaatggataccccattttccgtcaataatcttctgctttctctgcgtgtccaattcctctgatattttgctttcctttccgttcagcctaccaagaattcgctggaagacatccaaccctgcgcattcaccattatcaaactcgtcttttttgtctttacgttttaatttagcaccgagcccaacgttgtcgtccttaattgacactttgatatgcgaagtgttcgaattcatgggggataaccccagacccataccgggtttccatccaaacttttctagaaattggtgcccgaatctcgaggtgtcgttactccatgccgtatttctggggtctaaaccaaaccgctgtttggttcttgtagctgccaaacccattctgcttctttgtttaatggtgtaagctgcctatatgttactattgagtactcatctcatcgcttctttcagaacaaaatttttcatatttttttttttccttttctttttttttttttcttttgactgttacccggttgtttatatttgtaggaaaacaacaacgacagagaaaatatccttgcagtggcggctaatttgttagttgactgattgatcaccttcacttattaaagtaaaatcagcatacaagagatcagaagggagaaagagagtgggcaaggctatagtactttgaagaaagcatctttgaaccgaccagttctcttcacaagcaaaatctatatgactaaccgcaaggggcaaagggttgtgagagggcccgtctttctcccgctatagccgtcactggtatccctcctggctgcacaaatccgatagaaaggggaagaaggaagtttagtgccaccttatagcacgcagttactgtttacgctaaggagaggcatactcaatttttattagtcgccttctttagttgctgcgtttttatccacggttctctactaaatgcttgcgataagcgcttctattttcctccccaccgcgaggcggaaatggcacattttttttcttttgcttctgtgcttttgttgtaatttttggcatgtgctattgtatgaagataacgcgtggttccgtggaaatagccggaaattttgccgggaatatgacggacatgatttaacacccgtggaaatgaaaaaagccaaggtaagaaagtggcaatatttttcctacaaatagatctgctgtcccttaaatgattaccatacatatatatatttattacacatctgtcagaggtagctagcgaaggtgtcactgaaatattttttgttccagttagtataaatacggaggtagaacagctctccgcgtgtatatctttttttgcgctatacaagaacaggaagaacgcatttccatacctttttctccttacaggtgccctctgagtagtgtcacgaacgaggaaaaagattaatattactgtttttatattcaaaaagagtaaagccgttgctatatacgaatatgacgattaccgtgggggatgcagtttcggagacggagctggaaaacaaaagtcaaaacgtggtactatctcccaaggcatctgcttcttcagacataagcacagatgttgataaggacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgtttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaaccatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgcaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccttctcctggctttgatccaaaattggctttaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaactgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatctattcgacgatgtcctaagtgctgtcgattctcgtgttggtaaacacatcatggatgaatgtctaaccggaatgcttgctaataaaaccagaattttagcaacgcatcaattgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgttgccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaatttatattatttgttgcatgatttttctcttttatttatttatatgttgccgatggtacaaattagtactagaaaagaaaacccactactatgacttgcagaaaaagttatgtgtgccatagatagatataattgcatacccacattgtatactcaaaattccgaaaagaacatttcattttttatgaggcaaactggacaacgccttcggtcctttttcattctagaaatatatatttatacatcattttcagaagatattcaaagaacttattgggatgtctgtttactgaataaagtatacacaaaatacgaatttaaaatggaaggcataaaatagaaaacttagaagtgaaaatcctaaaaccgaaggatatttcaaatacgtaaaagaagtgaaagataaaataaagcctaaataaggaagaaaagaagggataacatttttttttgttactttttgcttattcctcacctaaacagaaggaaaaagccattcttgtttaaagagtatttttaaagcgttcatgaaaagtcacagtccaaggagtatttcaaattgtcacttgaagtgaaaacaccccagtgcttctcgacatcagaggtaccagaggtgtttggcttccaatcttcatcaaaggcttcaaaaacaataacgttaacaccccaagctctcatggaacagataccttctttccagaattgtttggcgttgtcaacagatgggtaagaactttcaaagttggtaccatcagttggccaaccggtctcaccaacccagaaggtaatatcggtagaacctttagtagattggataacctgtagagcttgcataatatcatcaaagaatgagtaagaggcattttgcatggtttgaccttgccagtaggagaacgcgttagccataacaaaatcggaagcttcgataacggcagaattgtaaccagcaaccaaaacattccaggaatcgacagtaccgacttgcttaccagagtatgactttccgtcagaatcggaaatgtcagcaacgacactacggacgtcattaattttgtctgataattgagaggcagtcaaatcgttacggtataaggcttcagaaccaaccaagaaaccagcaacagtggattctttaatttttggcaaataggtttgcaaagcagccttttcagcagcgtaatgactgtcgtctgttggccaaacaccgacaaagatagtaaatccctcagcttcagcagcaggacctaagttttgcaaagtgttacaatctgaggcagcgtaaactttgacggtggaagtgtagctcttcaaagcttgtaattcggtttcatagtcggaagtggacttacaagtaccatcgttgttcttgacacccaagttaaaggctagttcaccaatagctgaaacttgggaggctgtgaaaaatagcgcagtagctgcagtagcgagtgtagtagagaaacgcatctttgaccgtttttctttttggttagttgtctatctcaataaacttatattgaaaaaaacaagaagaagtccaaattgtgaatgaggaaaagtttctttataaggaggcagttaaaatcaaaataaacaaatatcctcttgttttcttcgtgacatttttctctttttcagggcgaaaaactgaaagaaaaattttaacgtttcttttactaaaaatagaactgcatatccgtagaaaacgatgattatataacataaatagtaatatcagttattaattgctatttatttcaacttgcccaacgctgaaacatggtaagagctatgggtaggctatcttgaatgggtatatttccctggggtacggaagcagggaattgcagttgaccagaaaagtaatgatgcaaagaagaggattctaagtcagatctcctgaaacaacgttttaaatggccccatttcccgaagataagcaggatattacagggtttttctgatgttgaactttttttcagttttgcgatgtatggtagctttgtttctaccttgtggtactttgacaactcttcgtcgtagtggaagtcaccactgttgacccaaacgatctttgtgtaaccttcggacacctcattcaaagtgcttgccattcgaacatgatagccgagtggttttcctttgtaagcatctatgggtgacactacttctttgcgctctgtatcaactgttacacgcgcagtattgggaatattttggttagataacgtaataatttgattctttcctatatacaccaaatttgttagagcatcatcagatttaccttttgagctatctcgtgcgattgataagccttccttgtagtgttgttcggcagatgcgttcataaaaggtagctggttcaatggcggaaaggtagatgcacactttaaatataacttgttttttttttgaatgtagtatccagtaagtttggaggcgttacaaaatattgtaatagtgtggcaagtaataaacaatcagagatagtctcctttgatcttgattttttttcatgctttttatcttttgactggtctagaactatgatttcttgaacattgaacaatacagctgtccgagctatttgatatgcagtaaatgtaacttgctccaaattattacaattgtcgataacagttgtcggtatgcatatggaatatttgaccacattagattctatatccatgattttttttagcttcaataggcctgtctttgcctttttggcagccccctcttcgtgcttaaggctctcggatttatgttttactgccatcttcccctattatgctacacttcccttggtagatgtgtttcacctcattggtatcaattacctcctctacttaatatcccaatttcaacatggtgttttcaagcgatgaggtggaaaaaatttcaaataatatgtttgggtgtgcccattattgcggtttacaatagttgctaaagagctatttattaggaatttttaaactttagagattgcttaaagcgactttaaagcgtttctttggaaagataggagagcggatgctatctcaagagcatctcttcaatgatttaagcagtgacagtgtaaaacaattacggaccaacgaaaatggtcaaatcaaaactaattacaataaataagttctatcataatacaagggaattctgtgcgatataaccacattgattgaaggtagaatatacaagccaacgtgagaccaatcaaatttcgttaagtgcgcctatacaaaaagaaatcttttatgtagatatgacagtaagaaaagtatatatgtgagctagcagggtattgaaagcgatcacaagaaggcaaaacgaaatagattgttagaagatgagtgaacagaagggacataaagaaaagatttcctttacaatctagtaaatcttcttcttttcatcaacggataattcaccagcgccagtattagtaactaatagaagcccaccaatgatgcttaagttctggtaaaactcatacttcaagaaatctctcttagtattgttataaaaccagtagttgtttagcgtgatattgtaaaaagttagtatcaaacccaacataatggatgcgaattttgtcttgtaaccaatggcgaaacatattgtgccgataatggtcaaaacaacagtaaaccatgatttactgaaagtgaaagcgataaacattaaaacaattaaaattctaccagcaaacaacaggtaacccttcgctttgtcgtttttgctgtttaattcaggaagcataccgaatgttgtcttgttttgaacaattgaatcgctgaatgcaattaacaacccaccaataacactaaagtttcttaggacaaatgatgaacccgtaaacaacccataaactaatgcttgagaaataacgcaagcacataacacaccggtggcataattggtttgctttcttaaaactaacaaactggcgccaatcaacatggaaacggtaacaaccactagaaacacaacgacaaagaagtatgggtaatgcttccacttattcagataaaaaatttgatctgaccattgtgataagatcctaaacgaatcttcataaaaggtggccacaatgaaaaatcttgacaaacttggaatgtaaggcttcaatttataaacaactgcattgtcagtgagcccctcaattctggaggcaaacttttcaaaagaatgcttccattgctttaagatgccagaagtggattggttctggtttgatctgaattgtgcaccgccagagtatggtccttgcgatgatgacattggcataccgccaaaatttccaataggtcctctgtaagacattgatctatcctttcagttttgttttcactttttttgagtcgtactaattgcagctattgtaagtaaataaggacacctttgatctttcgttaaaggtgtcctttatttttcgcctttctcattattccctcttctctcatcttctagaaatacctaaaaagggaaccgttacccgaacctattcattatagaaataaaagagaacgttctctataatattcgtatacattcgtatatattctattccatttcttacggtattcacacgaagtaggacaacaagctggatggtagtttgccagaatcgacaatagtctttgcagattccttcaaaacttccttggcaccagcagcattggccttgatcttatcggcggtggacactaactcttcgtcattcaaactgtcaacgatcaaaccaacttgttcgtcaatcgtggtggccttgtcagcatcaccaaagtagtcagcttccttagcagagttacggatggctctcttgttctttttcttggcggccttagcagcttccttagccttctttttgtcagcttttgcggaggcgttagccttggcttcagattcagctttagccttcgcttcagcttcggccttggccttagcttcagcttcagctctggcaccggcttctctttcccattttcttctttccttttccttcttctcttcttctttgaacattttgatacggggatcttcactgacagctctttcaacaagtttgaccaatctagcgttatcagcagtcttcttcttgtctcttgcggccttgttctttctttcaatgtaacgcttgtggtctctgttagaagagtcatctgggacatcttcgtccaagaactcaaaggttctccaggagtcaaatctgtgccagaaagcatagaattgttcaacttccttcttggaagaatctttgttacctagagaaggaataggagtcttcttagaaaaacgagcttcagcttcgaaaacggggccccaagcttcataaaagtcataatcggtacccttctttggaggaggaacatcggcaacaaaatcacatgagtcgtactgagctctcttgttggaatcagtcaaagtttcaaaggccttttgaataatcttgaaaaagccatcttggtccaaactaccaccagcagcagattgcttgtctggatggtacttgacaacttgttttctgtgagccttgatgatttgactttcagtagctctgaaacgcaacttagacaaacccatagcagcatacaaatcggcagttttccagtctctagcatcatgagtcagtaaatcttcatcggccaattcagtgtcgaataacaactcatctgggtcgacattggattcatcaacggttttgacgttcttttcagcttcaattctttcaaattcagaccaggtgtggtttctcaaagttctttgagcatgttgcaaaaagaacttaccaaccggttcgaccggacgacggacgaatggggttttggtagcggaactgttgacttcaacagtgatgtctgaggttagggtaggtaaagaaaacatcgttactcttgttggtatatgtgagacaaaacgaagattttataaaagcatcggtaggaaaaccttatgaaattttctctaccagctcttgaaataaaaatttcgaactctttgcaaaatttcatcgagaaaaaaaaaagattcgtatttgcgggtaatattttttggacatttgtattaggagcgttatgttcattaatgtcatccaaaagatagttataaatctatgattgtatggtttctttgacatatttatagttaatatatatatatatatgtgtttaattttataaaaattccatcgtttatattcgattatttttatatgtcaaccttttttttaagaaatgttcatatttagtcaagttcttaatgaaatgaacggttgaaagtacaaggcaactatcatttcaagatataaaaaaattgcccaaaaaaaaaaggccatttgatgaaatgtctcatcgcgctacgatttctgctgtaatcagaactaaatgcgtgatcggaagtaatattagatattggatgcataaaagataaaacgccagctaacgatggcagaataaataggtaaatatatatatatataggttttcttaataaataagggagaaatgtacagttagaatcgtagaattatccacatatccctatcttcaagatctgtcgtacttaaatgcctccataggttgcaatccccatttagccaacattgccttgtcttcgtcccaaccgttacacattgtcgtcagcattttcttaccggtgaagatactgttacaacctgccatgaaacagacaaattgctctgtttctttcattgtataacgaccagcggcaagtcttataatggcctttggcataactattctcgctgtggcaatggttctcaaaatttcgtcgaattgcaactttttactctttggatcggcaagttcctcagccattggagtccctttgatagcaactagtctattaattggtagggactcaggatgaggagacatattggataatgtgtagatgaatcctatatggtcgtcttcgctttcaccgagacccaaaataccaccggtacaggcttttattccagattcttggacattcttgatggtctgtaacctgtcgtcgtaggttctcgtggtgatgaccttactatagtgttctctggaagtgtcgatgttatggttgtatgcagtcaaacctgcatctttcaattgctttgcttgatcttgatcaaccatacctaaagtaacacacgtttctagccccatatcattcactttggtcaccatttcctgaattcttttcatggctgatttacgacctttcatgtctctccatgcagcacctaggcagaatctagtagatccgtttcttttggcctcttctgcctctttaatcacttcatccactttaaccattttctcagcctttagaccggtatcgtttctcgaagactgcgcacaatacttacagtcctcagaacaaccaccagatttgatgttcatcaatgtgcacaattgcactttggttggatcgtgccactttctgtgctgcaattgtgctgcatgagtaagttcgagcagtggggtatgataaatttcttttaattgcgattttgtccacgaatgacttggttcatctaaagacaatgcatattgtagagcacccagagtactagcttctgaggatgcagttgtcgatttaactgcggcattggttgcgtatttagttaaagccggtctagcggtagataaatgacggtagatagtagacatcatactgcactaaattgaaaataatcggctaagttagctcttctgaggacaccactaccagaagagtaagatctgaaaaattttcagcaagtatgggagcaaaaaaagctttgcccttttatataagatctgcctaagagaagaaataaaagataccaagagaatctagcagagtggcaaacgaactacatagcctgtaaatacagattaggcagcagcgtagcggattttcctcaggcatcgtctctcacgtgaaatctgtgggggcaccagcgtgacagggacggttctaatgctttgcacttttcaacaacttttttccataaccaaatgccggcaaaatggcttcgaagaagacgcgagacttcatccgcgagtcatctcgacatgactatcttttgctagccaacacgcccctccgcaacttcccacgataaaattgtaaagaacagtactgatggacagagatttgcgcagtggcattttttgaaaataaaatgaaaaattatatatatatattccatacatagtatataatatgaactcgtttgacttggaaaattttagatgcaacaggcaatatcgttgggcttttttatttgatcattagcttatttgaatatgaaggtaatgaccaagggctactaatgtctttctattaagccgttttacaattgtatattttgtaatttgcatcgcagtcataacttcttgcaagaaatagtagtttcacacaatgaggtagtttcgttggagatgcagtaataatgcagaatacggatctcacggaccccaagagaaagctacgcaatcttacggcttgtaggttctcagttcccaatcgatgcaaaatgggtaagtattttcaagactgaaataaggtcgcttagaaacggttatccatttactattatctggaagctgctttccacagctacctactttggagtaatggtttccgggaagacttcatcctagagcctcttgctgttgttattcgaagttcagattcgtaaatggtagtacgttctgctttcgcaatgaataactaggtcacataagccctaaatgcgtcagtagaagatcagatgcattgaccacatcatatccttctaaagtaattaattgagatttaatatttttcgtactgatgagaaagctaaactagtgcaactattatagtcacatttgtacggaaaaggcagaagcaagaacaatgacttgaaagagcgtatagctatttaaccatttccatttgtatgctataattcaagtatttccacactcttaactaaaacgaatcagaagagtaggctactaagaaagatggctatccttaataagtactatccgacgttgaattgaagattaaactgagccacacattcccatcttctgcacacttagttccttatttagagacttttatgataaaaatttcttccgttcactgttaaacaaccttgggaacaatgctgactgtgcaggaaaatgacctatgtttgaaggatgttgccacataattgaggcatgttagcagagcattccctaccactggaaggagtgatggttgatgtattttccattgagactgtgacattgtgatacgatacctaatcaacgaccctatataactcattaaaaatggctttctagaagctacatctatttgattaaattggttcccattttcacaaatattttgccacctctccttctcgccaaggatttgtacaaaattaacagaccttttagaataaatattaaatttaggtcagcagaatacggccaccatctcattctttactagatcaagcgtcaattccaataattataaaaatataagtcaagaaagcatctttcttcgagtctcctgcattcggtttgcgttcctctctcgttctgcttgacaaaagaaagagttttttattctcctaaccaataaattgaagcaatcagctatagggttagatgtattcgttttcctttctgaccccttatgtccccatttggaagttctaaacaaatgccctttggtgcccagtatatgtcaatgacgtctgcttggcgaatctctgaatcataagtgttacataaaaattaagtatctacggcgcagtacaacgccttcgtctggttaaaatcgactcttctgtcattaacataagaacgtataacaaaaaaaaaattatatcaatgtatacataaagctacccaaaacaaactaaaacatcacttttgtagggtttcttcgcacattatcattattattctttgagaatactcattcgctgatatatattcttccttcccatggcttcaatgttctggaagaggcatctacctccttctttggatagtttccaaactctaacttgaacgatgaatcatcatttggaatcttgaaatctgtcgcatcagagctaaagttcaaagccgcaaacaatgttttattgttgtacttctttgtgaagctaaacaacttcttattgtctaaatcaataaactcgaaatcgtatccgtacacagtaatgtctttatgcgcctttctaaacttcaaggcctccttccagaagttcaaaaccgagttgggatccttgatttcatcttcgacgttaatgccttctctgaaagagtcgttcaagtaaaaccatggtttagcactaggaccagaaaaaccagcatttggctcctcacgagaccattgcataggtgttctagcatggtccctggagataagggcaatggcttctaaaaactttttcatctcctctgagttttccccatgctcttctttaatggcattgtagttgtttctgatttcgacatcctcgtacttttcaacaggccagttcttgaaattgatttggccaagctcttgtccctgatacacatatagagtaccggtcaaggcacttagcaacacagagagtaacttaccagaaataacacggttcttgggagaatcgtcaccaaatctcgtaattgaacgaggttggtcgtgattttccagatagattgttgaccaacaatctgtaccattaatgtacctgaacagctcagcaagggcaatcttccaatccttcagttcaaatgggaccaagttgtaacggaacaaaggtgaagtccccacatcagtgtgggaaaagttaaataactcactaagttcgtgtcttgaagcactcgtataaagtctcttagtttcgtcggaggcatgttgcatttcaccaactgtcataatctccctgccatccttcactctgtttctgatgaattgattcatttcttgatggaactcgtgaatacgtggtccattcaatgtgtatggatcactggattgccaagtcgagtttttgtcaacaacaggagcatctggtaaacctacaactttggagtacaaacttccgacatcaattctaaagccgtctacaccatggtctaaccagtatccaacggcactttcgtagattgcctttctacagtcttcattctcccaattcaaatcaggttgagtggagcaaaacaaacgcaagtagaattcttgtgtcttttcatcgaaggtccatgcggaaccaccaaaataggatttccaattgtttggaggaattggcttgccttcggcgtcataacctttaggaggtctccagaagaaccagtcacgctttggattagtcttcgaggatctgctctctttgaaccattcatgttcgctggaacagtgattgatgaccaagtcggtgataaatttcataccaagcttatgtgtcttttcgatcaaggcaaagcagtcttcattcgtaccatatgttggccagaccttttcgtagttggcaatatcgtaacccatatcatcttgtggcgagtcgtagaatggtgagatccaaatggcatcggcaccaagctctttgatgtactccagcttggaggcaatccctttcatgtcaccccagccatcgtcattagagtctttgaaacttgctgggtaaatttgatagaacgtggcctctttccaccactttggttctgtctctggatgtgcagaagaaatagtcatcgatagtaaatattacgttgaaaagctttgtttgtatcttgtttgatctgtgcttgctcgattaatttgagacagcttttttatttcaaaacaggcgtctaaccaaacgtctagcaactcaatatcattgcccttaagtactttttatttcaaaaggagatcctttctcattctggggtaaactgtggtatgacgaaaaccatgaaaaataaggaacataatttatccgagtatttcaacgatcccaagtactgacataaactttagtagccaatttatagcgtggggtgcctacttcgtcacatttgatatcgtacagcgaaaaaacattagtaactttatttccttatttcagggccacttttctcgagaataacgctgcgtgctgagcggttgttcacaccgcggagttggaaactttattctccgaaatattctccccactaaaatatccttacgtattgtgaaacttagttttctttttgtattagggtgtaatttcttattttccctgtatttcaccgcatgcaaattcttacgatatttactccggtaaacgcagttaagagctattgtccggtccgactgaatgaatattcggttagaaacgcatatttgtggggaaataacaacctcaaagatatagacggagcagtaccgtaaggtttacagaatggcatgaccacccacaataaagcaaggacctcgagacacatgcctttcaaaatagaaataaaggttttcgaacatcatttttcgcttgttgtatagtagtctttacagtaacagtgcatctgagtacaggaacgattgtcttgataatatgtgaaaagtgcacacgaaattagagggtgtcctttacaagtattcttagaaacacattcaagagcacaaaagtcgatgctttaagggtcaaggtggtggaaaacttgactggaattcttgacgaaaaaacaagaaaaacgtgattcgagcaatcataaacatacagccccgttccaaccggatcttgaggtttcccattttagatggaaataagcagagcaaaataaaaatcttgaacaagtaatagtggtgactgcaggttacgttggcatataaagtccgggtgacctgggtttcctgcaccaccagcccccatatgctagcacaatgggttttctttatccccggtcataattactcattttgctatattcttcataacttaagtacgcagatagagaaaattaataatctcgatatatattaaagtaaatgaaaagtagaaaatttagccagaactcttttttgcttcgagtatgactttaactaagcaaacatgcgccaagcaggcatgcgactgctgtcgtattcgtcgagtgaaatgcgatggtaaaaggccgtgtagcagttgcctacagaatagtttggattgcacttatctgcaaccgtcgagaaaaagaggtccgaagtccattaggttgaggagcttgaaaagaatagcagaagtgcagagggaaagcggtcctaacaccattgcaactgctcctgtaatatataagagggttcccaaaaagctaatcgatcagtgcttgcggctctatcacgataatttatacgtaatctggccccttctttcgtacgatgaccttcacaaacttctggaggaaaaatacaatgacaattacgtatattggtttctgaccgctttatcagcggccaccctcagtgatttacaaactgaaataaaatctgaagaggaagtcactttcacgggaaaacagttatctaatctttgcatctcatcgtgtcagcaatttgacgatttggataacagcaatatattcaatattatgacgtactactgtttgcatcgtagctttgcacaaatatcgaacgcaagaacttcttacagactctgttgtgaagcggtcggtctgattacggtagcagggttacatcgggaagaaacttacggatcccttacatttgaagaacagcaacttagacggaaactttattacttgcttctcatgacggagagatactatgccatatatcttcattgtgcgacgagcctggatgccacaatagcaccaccgcaacttgaacttgtaactgatcctcagctttctatggacagtttccttgaaatgattagggtatttactgtaccaggaaaatgtttcttcgatgctttagccgctgactctacagatgcttcttgcactgaagagtcattgaaaaagatatggaacgaactccacacaacttcctcggaaatagagccatggtctaacggttacatagacatctcattttcccggcattggattaggatactagcatggaagctagcttatcaaatgaggggtagcaacttttcattgaacgctaacaatgggcaaataccaatagaaattgcgagagatatgttaatagacacttacttaaccccagagaatctttacgatgtccatggtcccggggtaccagtgaaaacattagaaatagctactgctttggtggacattgtaggccagtatgatcataacatgaaattagaagcatggaatgttttgcatgatgtatgcaaatttgctttttctttaaaccactataacaatgatatgctgaagagattttccaccaaatgccagaatgccctaattactctgcccatttctaaacctttacaattggatggttatcccaaggataatgaagacatagacccttgattaattttcatttttgtgcatctcaacttcctggtaagtgatagctttccattgtagaaactgtgtttccgcaacacaagggtaaaattcactgctaattgcgacccattttcatgaacagagtaattaattttctatttggaggtctacttttacaagtataagactgcttcttaccatgatgtctccctattgaaaattatatttaataaaatacttttaggcacgctaacgttagcattcttcccagaattcctatactaacagttttcagtatatatacacttttttactgagtgctaagagccagattggatgagatgattgtgtactgatgggagacaagtttagcttgaataggctagctgcaatatggatactttcactctcatcctttcgcttttgtgatttaattagcataatcaagatgactttatatacagcgcgttgaagcacttagtgccatgtaattacctcatactattgttgaagaactgtataataaagttttgaaatttttcagtgtttgagaagtattatatttccacattgtagctaatgaaatcatactttcgtcagcactgacgctcaaatgaatgatatgaagtattgctcgaccgttataatggagcactagttgaagggcagaggaacaagtgaaatacaacagctgagtgcagataagtgctatggtttgttgataatattacttagaaatggtgtattcagcattgataagaaaggggcggtactttttgctaccatgttgctacctctgggatttggatatttgagtgaatcaccattcgcttattcaatacagagaagatagataaatgccagttaattttaggaggcaagatattattgtcatttatgtttgccatttaaagcaacatttttatggcagaacataacattaaaagaatccgatctaaatttaactataatagttactagatacggacatatctctaggaactatgaaggctgaaatgtctagaactttggaaaagagatgtcctttctgcgtagcttaattcatttccttcctaaaaagtccgtagaaagaacactgcacctcgccttgggcaggctcctcagtgaaaaccgaagaaaaaatactacaaataaaagaagcgcgatgatacttgttttagatatatggtttacatctcacagaaaacacgtagcccttgacgcggggaaattagaaaagaagcgatgtttttcacaataatgcaatatatatctctattcttagtaataataacaatatctactgaagaaaagtaatacgccacatgaagactaacgactttataacctctcgcaaggcagacgaggactgtcagaccattgaaaacttgacgaacttgtacactagtagatttcccatattcttcctccggttttttgaaatcttgtttgactttatactgaaaaatagatcaaagaagccatatcagtggcggctaattaggtaatatttataaaacaattccattatattcaaattcaaagtgatagatttttgaatcacaatttctaattagaacaccttcaccacatactgctaacacgaaatttacctaattgtttgtgaggatgacgaccacatgggtttgattttttttactaatcgcttttgtatatcaaatgcaatttattattattttcatgtcaccaagaaagaataattctttgaaatggttgtttatatcctcagaattggaaaattatttgccaagcgattgtgaaactatgtgatatgttttgagatatttcatgaaccatatagaatatgcatagtatatcccaataaagcattgaattatgaatgtcgtatctctataagctctcacattaatgcttcaaaaatacttcataaaacattataatatagtttaatgtgatttttgcgtgattctctccttctttttattaagtgtatggacatttaaagtaacagttaattgagaatacggttgacctggcatgttgttcgaatcaatatccaggcacaagtaccaggtgctaaagaaaaagtactctcatatttgcttgattgctgcttgggctattttaactaactactaacaatattttgcttaaaaaatggtaaatatgaatgttttacagaaaaataaaaaatgtatatatataaaatctcgagctagctgagggttttgggagcagtcaaagggattccttatttcttccaaaaaaaaaaaaacaacccttttacttaacatttatcagctgcatttaattctcgctgttttatgcttgaggactgactgatactctcatcagctagcgaatcatgttgagtttttccctttccgaatggatcaaccacagtagatgcaaattttctggcaggaaccccttggttgaaaagttcattaatttcactgaaggttctaccagttgtctcaggcagatcgatgatgacccaagctaaagtgactgctgtgaaaccaccccagtatagaccagttttggcaccccagttccaatcgctcacgtttagcatatagggcgttaatatagcgttaataacggccatgagattgtagcaaatacgggccagcactatagtcttagttctcaactccgctgatggaatttcagcaacgatacagtaaacaactgcaccgataccagcattgtaaaagaatgataaagccagcaataaaccaccggcaccattactagcgctgcttccagaaccaaaacccattccaccaataataaataagcagaccatttgaaatgcaagaccataggtcagtattgtccatctaccaacacggccagatattacccaggagcaaagtgtacccgctaacccaagacagtactgaattagagaaaaagtaaacgccttgtcggtggccatacctgctctttcaaaaaaatatgtcgagtaaccaagtaaaacggcaccgctactattttgagctacccaagttaaacatgcaagtctcgttcttcttccattaactcccttgaaacaattaaagaatgatcctgatttagatgctaaaagtctttctttttcaatagtcaattcaatctgctttaaagtaagatcaacttgaatgtccttctcggcgcctttaccactcaaaattctgcttaaagattttcttgcctcagcgaccctatcctttctcaccaaccaccagggcgactcaggagcgaaaaagataccgatcattaaaggagcaggccaaatccattgtaaagcaaatggcaatttatagcccaagtcggagttccctaaattctcttgtgagtttttcataataccagaggcgaagatttgaccaaataaccaacaaatgttggagtaactggtcatgtaatatcttaatgctaaagggcaaacttccgaagcataagtaacagccaaactttggaaacaaccccatggtatagctgagagaatttgtcccacagcaatcatagctaaacttttacagtagtagaggataaagatataagcagttaacaaaccaagtgctgtaatcatcgtataacgattccccataaattcaaccatataagtcgtgatttgcaaaccaatcatctcaccacaaaggacacacatgtttaaaccaatctgccattgggaagtaatttcgtaagaaccctccccgttcaaagtaccgaattttctctgaaaaactggcagggcatacagtgcgctcagtagtgcggtatcataaccttccataaccagggtagtagacactaatatggaccacagggctgcttttggatattttagcaacgcctgcttcaaagtcatgcttttttcctcgctgttagcttcatttgcatcatcagtagcgttcatctcattaatcacattctcgttatcttcgtcagaatctcctaactgggctgaattggtggtgaactctaagtggtctagctcaaaggcactatcctttttcccttcttcaaaatcttcagtattgaaaacctcctgttggtttacaatatctcttgaagactcagaaatgtttttatcctcattttttgaggcagccttcttcttgcttaccaatgaaatgatatttttcatattatactatttttttagttgtttgatgttcttctatgtagcatcagaaagaaacaccaacccgaaaattcttcaaacaatcaataccaaaccgctttatataaaaaattaagatgtcgacattccttattttttactgagttcgttaaagttgggtacactcttgattactgtaattgtctctgtatgtccctcaagcccggtacgttgtcattttctagtacgcatcaacggagtgttacatgatagatagaccgagtagaatctatggctatggggtaattaaaaccttaaagctcctttcgctgccatagtaatacgaatagaccttggctatagtaagttgcatctgtaccgtagagattcttgcaactcgcttaaactctcgcttttagataatatttctccttattgcgcgcttcgttgaaaatttcgctaaacacggggtttaagttaaagtttacaggatttatccggaaattttcgcggaccccacacaattaagaattggctcgaagagtgataacgcatacttttcttttctttttttagttcctagcgtacctaacgtaggtaacatgatttggatcgtgggatgatacaaacaacgtaagatgaatagttccttcctcaattcttcttgcagcatcattttcttgaggcgctctgggcaaggtataaaaagttccattaatacgtctctaaaaaattaaatcatccatctcttaagcagtttttttgataatctcaaatgtacatcagtcaagcgtaactaaattacataaatgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatccaactacgaaaaggtctggcccacatatggtaccaatgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaagggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaagttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttctcttgaatgaatctttcgagcaaggaatcaatgttgagcaggaatccagagatgatgactcagttctcaatttttggaaaagggccttgcaagccagaaagatttgaagggattggtccgccctggaaatctggttcgtcttcaacaaatgtcaggaacttttgtacatttttcccgaccatgacggaaatgacaattttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctccagcagcagcaaagaaaattcagttaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacccaccacacccacacccacacaccacacccacaccctaatactacctcaaccctaccctaatccaacccttccatcctgtctctcaacttaccctccattaccctgcctccccactcgttaccctgcctccccaccaccaacccacaaatccaccataacagttaccctccaattacccatatccaacctcactgccacttaccctgccattaccctaccatccaccatgtcctactcactgtactgttgttctaccctccatattgaaacgttaacaaatgatcgtaaacaatgcacacatacttaccctgccaataccctaccatgccccatctgtcatactcaccatcacttgtatactgatacggcatacgcacacggatgctacaatagtatatactatctcaacttaccctactttcacattccactccatggcccatctctcacttcatgagtacaaatgcacccacatcattatgcacggcacttgcctcagcggtctataccctgtgccatttacgcataactcccactattatccacattttaatatttatatcttattccgcggccccaaatattgtataaatgcccttaatacatacgttatacctctttttcaccgtatactaaccactcaatttatatacacttatgccaatattacaaaaaaatcaccactaaaatcacctaaacataaaaatattctatccttcaacaataatacataaacacactcaattgcgtatcaataccaccatgaggtcattaacttaaatgttccttaataccgtcataccactatgctctattccatatattgtaatataactgtactctatagtcatacagacgcttttacttcaccctatcttctcatactattgtcatagaatcgcacactgacgcatgattaaaacgaataatttttactataaggcctcccatccgtnnnnnnnnnnnnnnnnnnnnnnnnnnnnnnnnnnnnnnnnnnngcggtctataccctgtgccatttacgcataactcccactattatccacattttaatatttatatcttattccgcggccccaaatattgtataaatgcccttaatacatacgttatacctctttttcaccgtatactaaccactcaatttatatacacttatgccaatattacaaaaaaatcaccactaaaatcacctaaacataaaaatattctatccttcaacgataatacataaacacactcaattgcgtatcaataccaccatgaggtcattaacttaaatgttccttaataccgtcataccactatgctctattccatatattgtaatataactgtactctatagtcatacagacgcttttacttcaccctatcttctcatactattgtcatagaatcgcacactgacgcatgattaaaacgaataatttttactataaggcctcccatccgtgctctatccttttgtttgaaacatttatatacagaatctcaaagcaagcgggagaagtagtaattacccagaggtcatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgtcacagccaatctgcgcttaaaatatgtgtttcaggcggcaactgctgtacgagcagtgacattgctggtcgcaccttaaatgtgaaccaacgttacggcacaccctgatgtactcgcattaaagttttttaaaagtattattacgattatcgagtgagctagatagaaaatcggaaatgaaatggatgcccttttcgaatagtagagtttctgtgcctaaaatagcccaacattgttgccctttttctatcacgaggttactgagccattgcatgaacgcgcgcgcctcggnnnnnnnnnnnnnnnnntagagtttctgtgcctaaaatagcccaacattgttgccctttttctatcacgaggttactgagccattgcatgaacgcgcgcgcctcggcggcttttttttctactctataaaagcgaaaagccagaagttactatctcgaataaaaaacccctcgaactgccatctcattaccgaaaatgaaagaaaatgaacttaaaaatgagaaaagtgtagatgtattatctttcaaacagctcgaatctcaaaagattgttctacctcaagatcttttcagaagcagctttacctggttttgttatgaaatttacaagtccttagcgtttcgcatctggatgctattatggctaccacttagcgtctggtggaagctttccaacaattggatttacccgcttatggtttcacttcttgtcctgttttggggaccagtatttgttcttgttatttttagactttctcgtaaacgttccttatcgaaacaactcactcagttttgcaaagagattactaaaagcacaccaagttcggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatcagtgtgctatcatcctaccatatgcgcaaaacttattgtctttctcctcctagagatgctgtattccatgcatattctgaacgatgggttggtgtttttatcaagcaaggttaatcacatggcgtggcttgctccacgcatcagtagaaaacgcataccgcagcggaatccttaaataataagtgattttactgttcatcaactacaatcggactctttcacaattacccttcttgttttccacatttactgttaaatgaagggatgtacagaaggcttaggaaaacctgtgctgaatactggatggacactgcattcccacagtgaagcttttatagatacactgccagttattttcgaactttcatcaagttgctgagttttagtatccctttgccttagctatatgtttgaatgagcaaaatatttgcaatgtctctagctttcttgaaatattggtttatattgagggcttggtaagatttcaaatttcattttgaagtgctcaggagaaaaatcatgctcttttgataatttggtgactaaacatacataaaacagtttaattttgggtggtaatggctgtgtgactagctatagaaaagaaaaaaattaaaaaaaaaaaaaaatacaagtagttcctgcactgcgacgtccattatagcattataaattggtccctgatttacgcatgcgataaactatttttagcgcagccgcatattatccgagaataacttccgacataagaaaattcgcagaaaatagataaaaaaactgctcttggcattcttcacttcctctattacacactgtgtcataccacaatcatctcacagtatgtatttgtatgtttatacatgctataacgtaaaacaatgtagaatatatatctaaatacctcacggttttagtttagtgcagcccacatactacttttttccttttgttttttttttatatttcaaaggttaaactcgcttagactatgtctataatataaaaaaaaaatagctctattccgtttcttttattctatttgatatttccatcacactttcatcttaatcacggatgtatactgataatagggttgactgcgcctgtacggattacagtgccctcttcaattggaaaatccaagctttcaagatgggtaactgttattcaaaggatcctctaagataaaacacagatcggcagatccgagagttggcttctgtgccttgggctcaaattcctttcccacctcattcaaattgatttttctgactccaaaaaaagacaaagccctgcgatagttcccgaatgttgtaacatcaaagccaagcactcctttatagaagtcgcatgaacgttgaatactagcagctggtgaaactacagggtctaaactaactagtatccatatcgttttgagagcattgaaagtatacggagtacaagctgggttagaaggaatttttatcttaacagcaatgaaaatcaactttctagactgaatccctcaagaaaattgcaaaagactaaccgatactggtttaaaagagaaagatgtcaaatatgcggagttataccatcaaacaactttggacggccccgaaacaaatgtccgcaaaaaagatcttattaaagtgcatggacactatcatttctataatacaaaatactccaccgcacaatagtttgtcgggaagtcatcaatcaatcttgtacgagctttacaaataactttttaggatcggtcccctcataaaattatatataaatgggttagtttccttcttcttctgttaacatgaagttgcttcgtactgttttttgccttgcttctcttcaaaagaatcaatcatgtcacagtacggatttgtaagagttcctagagaggtagaaaaggccattccagtggtgaatgcacctagaccacgggccgttgttccgcctccaaacagtgaaactgctaggcttgttcgggaatatgccgctaaagaattgactgcccccgttctaaaccactctttgcgtgtttttcaatatagtgtagctatcataagagaccaatttccagcatgggacttggatcaggaagttttgtacgtcacctgcttacttcatgatattgcaacaacagataagaatatgagagccacgaagatgtcatttgagtattatggtggcatactttcaagggagcttgtatttaatgcgacaggtggaaatcaggactatgcagatgcagtaactgaggccatcattcgtcaccaggatttgactgggactggctacattaccaccttggggctcattctgcagattgctactacgcttgacaatgtcggatccaataccgatctgattcatatcgatacagttagtgccattaacgagcaatttccaagactgcactggttatcatgttttgctacggtggtggacactgaaaactcgagaaaaccgtggggccacaccagttctttgggtgatgatttttcaaagaaagtcatatgcaatacatttgggtataactaaataggtaagtttcaatgaggcgagttcagaatgaacagtgatgatctcctttctccataactatactatacgtcccttttatttactgtagtttttaagaacaaattctctgatgaaccagtcgtgaaaccgtatatcgttttctgccaattccggatgaaatgatgtcgcaagaatattgtttttttgcttagcggcaacaattagttcttgaccaccattatccttcccatctaatttgtacaggacctgcacatgttcaggatccagcacctcttctattactggggctcttataaaagtagcaggaaaatcattgcagtgaggaataaagtttgaaaagtcgcaaatccgggtagaagactgagcttgtctcccaaatgcatttctttttactttaacctttagtaaattcagcgtcttgaccagttttgcttcgttagataattgttgtgaaatataaatcaaacctgcacaagtaccccaggttaccttgcttgggttgtgtacgaatgcgtagagatcgtcgtaaaatcctgttctttctgcaataagggacattgcagtcgactctcccccaggtatgatcaatgcatcacattgagctagttgatttttatccttcactgtcatcacagatagttttttttcatagaaatccctgttttcgacgatgcatttttctacgtgtcgcacatgttcaatgaacgcaccctgtaatgccaagactccgataacgacggtcatttttgagatattactcttgtcttggccccagcaaccagggtcatggtaagtgtgcttgctactcaaacagaaaaaaatgggcttttatcaatgaataacttttttttttttgttagctgaatgatgaaagatggctcaactattcttacagtttccaataaagtgacgcgccgcccaatggcataacagtagtaggcacattatatcgtttgaatggcaaaatgttgtggcaaggaaagagcagaattatttgttcatgtggaatgaatttcacacacacacacacacatatataaaactagtatgtttctccaccatagtcacattattattcgacccttctaggaaaggaactataatagaaaaataagtatatcgtaaaaaagacaaaaatgtcagaattcaaggttaaaactgggcttgcccaaatgttaaagggcggtgtgattatggacgtcgtcacacctgaacaggctattatcgcagaaagagcgggcgcttgtgctgtaatggcattggaacgcattccagctgacatgcgcaagtctggccaagtatgccgtatgtcagatcctcgcatgatcaaagaaattatggaagctgtttcaattccggtgatggcaaaggtccgtattggacacttcgtggaggcacagatcctggaagagctgcaagtagactacattgacgaaaggaggttttgactccagctgattggacacatcacattgagaagcataacttcaaggtgccatttgtttgcggtgccaaggatctaggtgaggctttgagaagaataaacgaaggtgctgcaatgatccgtaccaaaggtgaagcaggtaccggtgacgtttccgaggccgtcaagcacatcaccaagattaaggcggagatccagcagtataaagagaatttgaagaccgaatccgattttgcagctaaggccacagaattacgcgtccctgtcgacttgctgaagacaacactatcagagggaaagctacctgtagtcaattttgctgctggtggagttgctactccagcagacgctgctctattgatgcaattgggttgtgaaggtgttttcgtcggctcaggtatattcaaatcgtcagatcctgagaagttagcatgtgctatcgttgaagccacgactcactacgataacccagcaaaactattgcaagtttccagcgatttgggtgacttgatgggtggtatttccatccaatcaattaatgaagcaggaggcaaaaacggtgcaagactttctgaaatcggatggtagaactagcgatgctcacacaacgctaatttgtttccttcgaaggggcagtcggctattgtagtttctatatattatgtagcacaacatggaaaccatattcagccagtttgtatatatgagaattaaacgttaaaactttttcatcctatcagtcttacacattggccttgcctaaagggcacaatcgttcacgtatatacatatgtatgtttacgtatatatatatgtgtttacaaatatgcatgtatattcttttcgaggaagattattatatgctattaggcgatgagtcggcttaattttttagggggacgagattggcgcgttagtgcataaagacagcaaatcacctggaggtgacaacattaatgcatttatcggtttttggctatgatgcaatgagtacagttccaattgaacggctcatgaactatgaaatatacgaattattcaactagcagaaggcttgaaatattacttattcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaccggtgtcttgtacttaaagggcagtggtatcactgaagacttccagtccctaaagggtaagaagatcggttacgttggtgaattcggtaagatccaaatcgatgaattgaccaagcactacggtatgaagccagaagactacaccgccgtcagatgtggtatgaatgtcgccaagtacatcatcgaaggtaagattgatgctggtattggtatcgaatgtatgcaacaagtcgaattggaagagtacttggccaagcaaggcagaccagnnnnnnnnnncttctgatgctaaaatgttgagaattgacaagttggcttgcttgggttgctgttgcttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcaattgaacaacgatctatcctacaagcaataccaaagatgttacgcttacttctcttcatctttgtacaatgttcaccgtgactggaagaaggttaccggttacggtaagagattagccatcttgccaccagactatgtctcgaactacactaatgaatacttgtcctggccagaaccagaagaggtttctgatcctttggaagctcaaagattgatggctattcatcaagaaaaatgcagacaggaaggtactttcaagagattggctcttccagcttaaacgnnnnnnnnnncacttcgtcactcctcgagcgcagccttcctctacgacttgtgtatgatttcacattaggttttttttcctccctgatatttagatatttactattaagatattatttatgagccttttattacagcttcttttcccttgtaattattgtacttgcctccaagtatcgaaagtcttgcgttgcctcaatttgccacttcaaatactgtaatctgcacaatttacgtccgaaatagatgagggataaaagctgtttttaagtacggcttattcaaaagtataaaagtagagagcatagaatatataagggcatatttcttacacaaacgcaccaaaaaaaaaaaatctgattaatcgaaggaaatctgcgcagacattgccgtgagaagtgaagccttcttggtaacagccggatcatcaccgataaaattagtaggaaaaccaacatcaaaaggaataatactttctaagtactttatttgttctggtgttaatttaatgctcaaagcctcaatgttctgtttgaggtgttcaattttccttcctccaaccaatggaaaaacatttttcgccttagagcgaacataggcaatagcaatagcagtaacagattcagtgccatgttcctcagcaaccttggccaatgcttcactaatcttgatttctgcatctgtttgttcagaggcgccaacgaaagaacgaataccctctccattcttcctccgttcctccattgcttttttactctgaaatcttccacctcccatgacatcccatggggcgagggccataccgaaatgcctagccattggaatgatatcacgttcgaagtctctgttcaacaggttccatttaccttgatagatgctaaaaggggttttaccatgagatttagcgtagtaatttgccgcagaaacaacccaggcaggcgtatcagacacacccaaatagaggaccttgcctgctgcactagaatgtgtaaactatccataacttcttcgatagaactcatataatcccaccagtgaacgtaaagtatatcaatccaatcagtttgcaatttgcggagagaatccctcacactcacatgcaaactacgcttgtgattgccacagtagtttgcgcttttaccaccaccaacgtcgtatttcttatagtcagtggtaaacttggtggcgattacaatctggtcgcgtaattttcttgaaaccatccattcaccgatccaagcttctgactgttcgttttgataattatttgcagtatcaatgaaatttccacctgcctcataaaaagcatcgagcaactcaaaagctcgctccttgctcattgatcctaggatttcagaccaagcgtcgccaattgacattcctcccaaaatgagaggggaaactctaataccagcacttttagaaagaactctgagacgtcctaactctgtagatggttcaggagcaggagcaaataaatcagccatattaaaaatcgctattgaaaatgatatagaagagatattcagttagtactgaatttatatcgattgattgactgatttaggttgaacagagaggaaattgtttctcattgcgacggtattgctccttttatatgtctgaagattgagtgcttattttctcgaatttgtgcacgtgaaaacggtgaacgtggttgtataccttcgatacggatttgcttactaattgagagcaaaattagtaagcgaaatgtgaaaattggcttacgaattagccactgcatgttctacggtttccacaacaaaactgcaagaacctgtgttgattcggaacggtactatctcttcgtaatatcaaagttcattttgcgttactccatcctagtaattctttcagattccatttgaaaaggctaaagattctataggagcggtggcaaaccagaaagtctaaatattgttatcaatccgtgcgttgttttgctttttaaaaccagcaaggcaagcagatgcaatatagatctttacggcttcctgtacgcacattttaaactcgacaagccagctccttctcctgttcacgccctctacgaaccatgtgattattagcactgtatttgagaacaggtcggtgtatcattttctacaattttgtacatagaaaattaaatgccggatgattgcgattatcaattacttagcccttgattaaagtcacgctttcaccaaatatgtgctcctgcgcacttcttttctgccatcttttttttattattttttattgattcccacatagaatccttttcattaacaatgtgaaaccaaagaagagtagtaggttcacgttatgtctctctttagcatatgtctctctttagcatcgccaaaatatgatttcaaaatccttgagcctattataccacgttccaaaacttggccaaaacaatgctacaaaaagcgatggacttaatgctataggagtctggttactggctgcaagtgaattcttcacccaactaagcagctttctattagaaaatatgtttatataggtctaaaccgtcatactattagtgctggcttgaaggatggtattattatttgtcaggtgtttttcttaacctacgaaaaccaaagaagcctcagttttttttttcctcctttgatccgaatcgagtaggagtacttaacgagttgaaaagttttcaattccttgttaccaaaggacacattctaacaaagcaaaagtcctcatacagacttgacgggatatttctttctatataaaaacttctcaaaaagttttttaccacaactgtggcaatgttaacgctttttgtcgaagtagtgtagcgtagcgccacactattcaaggatacatagtaaatcagagaaaggttatcttgtaagcatacatattactggagatcatgtttccggagtaactccgctggtatttctactaagctggatcgttactatataattgatggattctgctaatagattccactctttttgtcagttctcccctcattgctctgaaaatatacaagatttcagcaatcctcgctaatggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctgaccattattgtgaatataagctatttgagaattattttacctttttacagccgcccccccaggataaatatttcaagttgtggtaacggaaaagggccttacatactctagtgagcataacacgtacaatgaaactatgattaagtcttctgcgctttttagagccgatgtaaaaaaacatgcttttttataaccaatgcatgaagtataatttaggccccttttgagttaaactactcagtgtcgaacacaagtttgagatttcgcagtcaatttttgggttgactcgattatttgctttgcaaacttcttgatgagtggttcattgcaaggatgatttgtttttgttatttcttattaaggatatgtaagatggtataaataaagaaagtcgtttatgaaagagaaaagaaagaagaagaaaaatcaaatttacggcaaaaacaataaatcaatgttaaagcactagtaattgccggatgaaaaggttcagaaattggttgcggaacgtttttacgccggccagggtttttcatagaccatttatgagatattatacagcaatattctagcacaaaagataatcaacccgaaatatcaatttcatagggtataaacccaagaacctcttgaccggtgactttttctccgagttatattctagaccaagcacctcttttcacctagcacatcttatcctgttcctgaaaaatacagtttatacgagcttgcgtgttttccaaagaaaagagcaaatgcaagattcaagattactgttcttgttttatttgcacttatccaatcaaaagctcgtttagggattgtagaagagctgactattgtagttaaatattaggggaaatgaatatattttatcatgggaaatacgtggaacgtgtaatatgttgttgctgctcccaaaataaatttacctgacgaaaaccttatatttccggaaaaaaaagcttaaagataaaaggttaattgtacttttaaactcttgcggaatctctgtgctcggagaaaaatatcctggaaaagaagatgcggggtaggcggacttaaaagataagtgcacatttttccggacttcgagtggcgacagacagcctgttaactatttttgagaataattaatctttaggggggttttagtaaaacaaacaaaagactcaaaataacgccaagaacatccgaagaagtcctggtcgcgctttttgctgaggtggctttaaaaaactagtttgctgagagatgtaataatggctttaacagataattcctcgtttggccacattatcaaaaggcaacctctttctgaaaacggtatagccggaaatgactgccgagttatattattgttcggtatactcaagttattggtacgaaatatacgataagaatctaccgaattttcatccatttagtgagaacgttgggtgaattgaaaaaggtgatagatttttctgctttggccttggattagccaaagtatcaatccttaaaatatttgctggcagtgtgatttttgcccctatctgagcaaattttgttatctttttcaacgtcaggctgaaattgacaacttgagtaacgtaaatcaatatggcacttctccaatttatatcgcatgagaaaaatagcattggtcaatcatacagaacgtaacatcaaaaaacaaccgtttacatatatataatcacttgtctaaaattgattgaaattgcatatgagaaaatatatgataatgacaataattttctttgagcacaattagtttatttggcaacttgctctttattattagtaaatatagcacatattcatataaaacacatcttcagtgggattacctagttgatggtgccaggaattttcctatcgtcaacgagctgaaaattttattatttttattaataacataatgtgagactcctggtttgacatttaattttacgtattagtcgaattttgttcttgcctacaataaaaagacaattaagccgcaggcagtctcattctttattacaaaaacaaaacgatagaatttagagcacaagtaagagatggtaacaaagtcacggctcccggatgtagtatgtcgtcaaataataagttcgtgaaattaataattaggttataaatcgtaaaaaattgaaaatattaattatgacgaagtaggcacagatttcttgctgccagtgttgctgttgctgttaacaccagattcatctgagacagtgccatcattctggtggaactccgcatgtaaaagtttacctaccctattctcaatataaccgttgtctgggtagttgactggggattcgcatccagtaaaaatgaaaatgtcatatatgagtgctccagcaataccgccggcaattggaccaccccaggctccccatgtccaccaccaatgtgtgagatgaaaagcatgtggaccatagccaatcatggaagcaaatatgcgaggaccgagatctcttgcaggattgattgtgaaacttgtttgatatccaagggccataccaattgcagcgactaagaatccaataattaatgcggtcataccattgccaggtggagcattactatcatccaatagcgccatcaaacaacccacaagtatagaggctcctatgaattcgtcaaagaaggcatttctccacgtgacgtaagactttggatcagtaaacaaacacgcaccggtcgccgttgttcttatgtgcggacctccctcaaattctgtgatagagctccaaaaataaccataagccatagctcctccaaaatatgcaccgataatctgagcaacaatatatacgggcacctttttccaggggaattttcgaaaaattgccattgaaatcgtaacagcagggttaatatgaccaccactaataccgcctgcgacgtaaacaccaagcatacaaccgaacccccatgcaaatgatagggattcataggaaccaccactaccttttgttacagttgcttgaagattaccaccaacaccaaaaatgacaagaactagtgtcccgagaaactccgcaaacggttctcgcatatgatagcgaatttttgcccaaaagttaggaaatgtcattatatccgcgtcttcatcttctgaggcaccaatttcattaccatctaatgcactcgtacttttattttcctcttcaataagttcttcaggaagcttcgtataaaccggagtagaaccatcgagggtttgcatgttctttaattttctggattctgcatcggctatggaggatgcgtagctttcatcgcctaatgaaaaattgacattatgcgaagtacgctttttcttacgtgaaacattctcaatatgcgtgttagagggcttttgtgggttttcaggctctaacttagtaggtttcacatctgcaccaacagtattatcgcgttgcgtttgagcttcgatgtcaccaagctttttacccggtgctgcacctctaaggagccttttccagtctttcactgacgtagtagaacccccccttgaaatatcggtcgaccctcgtctcgatgatgcgcgggaccttgcatccatattcttttgtatcatctttgctgccaagcctcgatccaatacatgcggtaacggctgatttaaactccaaacaggcctgttcctgctactacccatagttggatttaattgccgatatagtgggtctacataattattactgttgccttgatttacccccctggatagataatcttgcattatacgtgcttgctcagcatctgaaaaactgtttaaagtcttcaaattaggcaaagaataagtaaaacccatggaagggacctgtggttgtaccgaatccttcctctcgtcaaccacttttttcaagggtgtcaaagcagaaagtttatttctcgatgatcctccagtttcaattgcttttcgagtctcacctagctttcgcctcaagagagtgctgtcattttcgttattttccctagattttttgacactttcttcccaagctattttaccattaggttcttcttttagcgttggtggccgtgtactctcggaagaggaggatgacctcccagattcgtaactcattacttgggtctagatcatatatcagaggagcgttatactgtgcgattatacgcttctttttatatgaataagggggagacatggtgaaaaggtaccagaacttttgatcgaccaagactaggtaaagctcaaacaacgtttataactcaaatttccggggtaagtggggtaccggaaaattatgatattccggagcggagttatcaacggagaaaactaggccttctgatggaacttaatttaaaaaattaatcacaacctatgcatattattcccgcagagggtgattgtgagtaaatccctgcacagaaacaattcccgccaggccataactagattctaaattatttaactcataatttcatgaaatcgtatcgtagtaccaaatagggagatattgagccaagtaaattcttacgtcaccatagttggataattaagtacttgatattgtataaggatctcaacaatacgagaaggggaaaataccgcaatgtgtgattgaattttcaaactttggatcattaaatatatataaatgaacccagatcagccctttttttttctagtattgtctgtaaagtgtattttacctcaaaatctgacaaaacccaactacaattgactaaataatcatgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactagaattgctcgtacacactagaagccaaacataacagctttaaaggctttcatttttgaactttttaaaaaattgaatactccaactgaaggtgaactagttgtgtctctgaatatatttttatagatatacgaattgatgaagtaccgcaaattaagctaaaaagtaatgcttcttgcagcttttaattgttctttctgcaatctacaattacttttcttgattccttctccgttcccctgtgttgtctggaagtataatttgtccaggaagattttttgaatagccattgttttctttaaattaaatcggagtgtttaaatccattccaatctcttttttctcgcaagtcaacaaacaggtgttaactttcttttccccgctgttttcttacctatgaatagtctcaattcctttttagaagatctgcacattctctgatactatgaacaagttctaggatagcaatctaagttttatgattctcttatttcggattcgatttcaataaagatcgtagtattagaagtatagaatgtattgtaattttttttcctaatcttattaattcatggaaggcattgaactcaacagcatattttaaatgtttgtatcttgttttctctttcaaaaaaaaaatggtgtcattcattattttatggtcaaccctatacatcaatttttctctgaaaatattgacaaataaagtagttgattcttgttctaccaattagtgatattatgcatgactgttaacaactttttgactaatctctgaaatcatatgaagatcttgctgcatttcatgcatctaagaaatcaacctatatcaacagatttcaataattactctaaacttatgctgtaacttagaaagtaaccagcctgtgttgactgattgagttgcgtattaactgcgcctagtcatttcaacacttataatttgcttcagcttaagtgtggttcatctttttttttctggaaactttgcatgccctcaaagcatgagtagttagttatctttttgacaatgatctcttttgaaaatatctactgtagatttgcatggacgcacgtcgcccatacgccaaactttggcaatgatactcgttattcgtaatatcagtccgtcaaggtgctgtgatttctctattttatattgcctattattttttcaaatgatttgagccgttttaaattgagtatgcaatgagtcttttgaatcaaccgtaaggcagttccataaccactgccacgaatacgtttcactaccttgaagaatctctaatgtaggccgtattcttcgcacttagttctgacgatgtagacatctcattatataagagcataagcgcctgtttctagaatcatttcttcgtgacccagctttttgagttatttcgcggtattttgaaacatttctcgagcttgacgtgaacatccttatatttcatgacaaactcgatcattggaacatccctgcctcgattttagagctagtatcaaatttcaatctctttgtgatggagccccgctcctatttcaaaagagaagtttcttgtatgcatatgttattgaagtctgattatagcaagtgcaatgtcgtctcaattattttaactatttttagccatacatgttagttatcctcaaagagagcctccagactgggaagcagtgtttgtcatttcaaataagtagatttcacagtttgtatgattttcgaagccaggattcattgggctttgagtaaagagaagccgcgtattacgaacagcttacgatattgtaaaatattcccttattgtggtgccccaatggatacatgccagagaaatgtctgtgaaattgaacaattacaatgacgagagcaagtaatccggcggccttgtctctctttcactagtaccgtctatatctcttgagcgccaatatgcgaaagctttcacaaggttgatgttcatggtattcggcgtcgatagcgaattgcttactaagaaacattagggtgcagtacagccttgtttttccagttcgactaacctttttcttggcagtatggagactgactaggtctcccaaacattcattgtaactgctgtttaaagattttgttctaacctaaattcaagtgagaagctgaacatgtgtctctacttatgatatcacgacagcaaatactaatcttgccataaatagtctagcgttttgcaacttacctctagatatattttatttcttgaggaaccgttttcgtcggtaataacaaaatactactgaaacgccacagcattgagagaatacgttatcgattacggctttcttctcgctccagatgtcgcgggtaagatattcacctcaaacttttcttgttgagtgtcgtcacaaatctagaacctacatgccatctcaacgatttttctggagaaaggcctcactccgttccgtacgtaatgcatagataaagtatcaggatcttcacgatgctcgagagttacttagtagtctgagtttatgcgaaaaaaactccgccgttgtaataatcgggaatacacagaagtagtactgcactatcactgggatactcaaaaaccttctttttaacttttctatcccacaaatagaacataggaaagaacattgactcctccacttgaagttaaattacaggaacaaacgcctaactataatttcgacattgttgcatcaacgaatcgaccgaaagaaaaatctggagttgcagttatcacttgtatgtgcactaagatttatatttttactcctgagatctgccaaatcggtagcttattgaactgcgttcctttttcccctgagttctcgaggtacctgcggctttgtctgtgccatctcccccactttaaagtaccccacgttactaccgcgtttttccccacccccggcttaataaattagctatatcttgttgacttaaatacggagaaaagaagaaaaccttcaagaaatgcttcattgtcttgtcaaaagagctaaagtaaaagagctctagttcgaagatggcccgcaatagacaagcgtgcgactgttgttgcattcgtcgagtaaagtgtgatcgtaaaaaaccatgtaaatgttgtcttcaacacaatctgcaatgtacatatcttcgacctttgaagaaaagaggtccaaaacccgtcaaggtgagaaatttaaagaaagtagatgatgtacaggtatttagtaaaagtagtagtggtggcataatgaaggttccaaaggcactaattgatcagtgtctgcggctctataatgataagttgtatgtgatctggcctttgctgtgttatgatgatctttacgaacttttagagaaaagatatgacgaaacctgtgtgtattggttcctggtatctctttctgccgccacgcttagcgatttgcagactgaaattgagtcggaaggaggggttacctttactgggatacagttatccagtttctgcatgtcatcacgccaagaatttgacgattttaacggtagtgatatattcaagattatgacgtactattgtctaaaccgctgctacgcacagatgtccaactcaagaacttcgtatcggctttcttgtgaagccgtggggctcattaagttggcggggttccatcgcgaggaaactttgaaacttcttcctttcgatgagcagcagcttggaaggaaagtttattatttgcttctcttaacggaaagatacttttctgtgtatacgcattgcgccacgagcctggataccacgattgctccaccacaaccggagaacgtaacggacccccgactatctctcgacagcttcttggagatgattagggtatttactgtaccgggaaaatgcttctttgatgctctagctaccgactctgctaatgtaacctgtactgaagactcccttaaaaagatatggagggaacttcatacggtgccacttgagatagaaccatggtcttacggctatgtagacatatctttttcacggcattggattagaacacttgcttggaagctagtgcttcaaataagcggtatgcgaatcagtttcctttcaaatagcaagaatacgcatattccagtagaaattgctagagacatgttagaagacacatttttaatcccaaaaaatctttatgcagttcacggtccagggatatcagtgaaagcactagaaatagccgacgcattggtagatgttgtgaatcagtacgatcaaaatgcagagtcggaggcttggaattttttgttcgatatatccaaatttgtcttctctcttaagcattgtgatagcacattagttgataagtttacgacaaagtgtcagtgtgcgcttatcacgcttcctctttctaatccgcttgaatcgacagatggttctaaagaagatgtagatgcgcttccttaagtaaacacattgctacttgcattttacctttcaagatgtagtgattacggacagttgaagaggctaatagcatctatttcttctttagtatatggttcctgcagggcaaacaattatttcctttgcaattttgcggcagtggggaagaatgatagcactaatagtgaacttgtggacaattatgctattatagcaagaaaaaaaatttatttttttttcaaggggggtgattgtgatgtgaattaaatcaaggatatacgcttttatcgtcatgatagtcgtgcgatttgtacttggttatagatgaaatgagttagtttttaataattgtgatcacaatatagctgtacttatcaggccattaaagtttcctgtaaggtgcacgagaagtcatggtcataaaattatcagaatctccaaggagaggttcaacggcgtcggttgcccatactccatattaagtaccctgtcatttccacagttacattagttggagtagtatagaaaccaaaaagatcagaactccaataggcagtatttgggtcacagtattcagtgtcacgttttttagtttcataaagaggtccgcaaggatcatatccatcctcatcacgcttcaaaactgcataagtcacacaggtaggagtgctctcacaaggcggactatagtatatggagagattggtctgtccgctaacggaacctaacttctttgtattggagtattcatagcccatatattcaggctccaagtatgtggtttggtcgcctattgtgtactcataaaaattaatattcataccatcttcccttttgtttgttggtaagcaagcttctgtactggctaaggttgtagtagctagcgccacgaagaccaagagtgccgaaaatacggaatggggtatagacatttgaaggtgtggagggatgctggtatcctccaattgttacattaagattatcatctggctatcatgaaatgaaggttacctttatataagaaagacttttaaaaaaatgttttgttttctgctttagggaagtagatatcgttcctgcattttgatatcaaaataatctccggtaggcatcaattgcagttaaagctctttctggcaaaaaccccgatacccatgtaggtacgctcttttcaccaggtcttaataatttgatgggcaccgtttatcccaggcaagccaaaaattagaaacaaaaaacaactcacgtacgttaaaaaacctgatagtgcttcgtactacatagaaccctgcgctgttatctgctaatcgagcactactaaattccctccaaaggaagtagagtatagattctatgcaccgatgtgaaaatagtaaacctacgataacctttttttttttactaaccgaattgagcagatattgttacctgttacggtcataaaagttaaacgattttgctttatttctgtccctggctgaaaatagtaaagaagagggaaggcaagttcaagggcagcttaataagtcatacgaaaacgttctcgaactttttttctgcaagcttttcagaaccacgatggaaaaaagaaatttttacaacactaatgccaagtaaggtttttcggatttagggtggcgtcctgaaaaaaaaagaaacgtctcagaacgtttcggagaaaaaaaaataaggtgtcaaatttcttagtgttttgacgggtgatgcccttccagataaatctcgtggagattggctagcgtcaaacgtcaccgatctctatttcttttttaggttattaaatttcgattacatcgcgtgttcttagataagttaccaagggtgctcaaaggaaaattatatttctttttttcttttgagtaattgcaggtgaagagatacagagcaaggaacgtgatgtaatgcatttttttttttgttccttggaaccacatgatttactcaacaaattaatctagtttgtgcttcaagcatgcaccattgtgaatatttttttagtttcaaggtgacaggttatgaagatatggtgcaaaagacaaatgtatggtggcaggcatagtaaaatgatggtgtggaagacatagattgtatttgttttgcattatccaagtgctcgagattggttctaaaaaacaagaaaataaagggcaagaagaaaaccagttacttctacattgagaggccagccaggttgccgcacacgtgttggtgcacgttaagttttgggctcacagtggtaaatcatagaaaaagcagttgcttaatttccctctttttcatattctctacgctagcactgtaaggaaaaacgcagaaagcaacatacaacgtttgttaggatgttcgtacttcacaataagcagacaataaccatttcaagtgtaaaaaaaattttttttctgttagtttgatgcagaagacttatacttttaacttttttggttaacttacacaaaccaagcgcacaacgcctgcgctttttagtattagatggcatgatttgaaaagcataaaagtctggatattggaatttagggaggcggcgggatagagcgatagtttctccccatataaagtctacaaaatgtgtgggtttttgatatcgatcgaaatttcacaaggtgttctataatgactaacatttttgtgagcagttgactctccttagtgcacattgtggaatatgtatgccatgtctcttaaaggggtaaaaagaggtattctgcatactaccagtggggtttatagcatcgtttaatcttgttatcctgtttcggtttcggcaatttctttcaaaattctgttttcaatgttatctgggaaagaaatgtttcgaaaaataatacgtaaattgttccgacaaaagagttcttgtctatgattattcaaaatgctgactttttatttagcgcttattggagtctttgctgtctgtagaaatctgaccaggcatacaaattatagttatttactaacgcaagaagtttattgtggttttcatgtgtatgtggccacgtagatttattttgtaaataagtatcgcgacagcttctattttcttggtttaatacgcctgtactaatttccatttttgagtttaggcggtgctttcgtaaaaatgatatgattattccgctcataaatggtagtcatggtaaggaagataaaaaaagcgcagttccactgtcaggcttcgtttatttaacaatatagatacatcataaaagtttttggtaatgttctctggttttacttcgtacttctgatcagaagtctgttatatcatggttcggtaccaattttttttatacaccattgtgatgatgttaaaactaaacgtataaattggtcaattatgttgctagtaatgcagctcaagcaaatttattttattggcctacataaagaaaactaactctacaacttttacggtataaatatgcaatgtgatttaaaaaatcactgaagtgtgtcagaatatgagaaactttaagtgaagcgtcatatttttgtgccctcatatcaaaaaaatgctttaaaagcagtcaaccaatgtgccaaaaattttcaaaattcaggaacttgttgttcggcagacttttattctgcctgctaaagatctgccgacctaccatagcggtcatgttaattgtaacggctatatctactgggtagactgacagttgatttccttcgaacgccaactctcgcattgccatttttagaatcatcgttaaatcttttatctcttttcggtaaaaaactagatatgactgatttggccccactacctgcggcttcgttgagcgttgcaggtgggtctatttttttgatccaatagctagctaaaaaccagcttatgacagctagtaaaagcagtacccccaaaattccataccaccacgcaatacttccatttcttcctggaacttttacattcataccgaacagaccagtaataacatttaatggaactaacattgtacctaacatagtaactttacccaacatttctgtaactttattattagagttaaatgattccacttgtaattgggccaggtagtttgcatgtgatctagaaaaaatcttttcgtacgccaataaattttgaaacatcgtcaacaaatgatcctgaatatcacctaagtataaagcaatatctccccttggttgtgatgttgtttgcatatagctatttgataagcttatttggttattactattattctggttcacattctcttgttccgcttgtaagttcaccatgttagtttgagatttaagcactggcccaataccattagtttcatcttgacatcttttggcgaacattttgataacatctgctttaccgctcaagagtctcatcagcgtcattgtcttacgcctactttcaccaatcctttgtaacatggctgcaaaatccatatcacgggtcataaacactgaatcatcaatcgaatcagcttcatactcgatggattgaataaccggagcaaaactatctgtgatatcatcgattaaagcataacataaccaatctgaattgacactgacatagtcacgtaattgtcttacacgtcttcttacattggcacagtgtgatattgggtcaaaatgaaaagtcaagacacctgacctaaaaacaacgatgtaaacatttataggttcaagataattctccgattctttatcattttcaaatgtatggaaacagacaaagtaataggatttgaaaagctctaccttttcacgcgtttcttgcatcctgatatcttccgcggtcaaaggatggattccaaatgtttttgctatgcaacgcatttcatcatcagttggacaactgcaatccaaccaccacgttggatcgcctcccttgaataactcataaaacgtctgtccctcggatatcaaagaagggatatcactagcatgcacagtttcatcagattcagagcggaagaacgaaaatctactaggaatttgatattctgtattttggagggtataatacgcccggctataactcgaatcatttccttctttttcaccttcaatcttatttctaccaaatgttacgtcagggtgtagatcaggtttatcatcttccctcacagattcattgttttcagatacgtacatctcattaacgctgcaatttttttcaagagtccgtgaaatttcaggtgtatatttcagagctgctgaggatcctgaagtggaagcagagttagtaaatccagtatcttggtcggtatgattgtatgttcgttcactgtgcctttgatggttcgccaaagacagatttctttcagcatttgaaatctgggcatattcttccaactcatcaaaatcaacaccattaactcttgtatgtaatagtcgaaacattggaaaacaaacgtcttcttctgtttcttgagaatccctggatgcttgcgatatctcactatggaaagataccctgctatccatacgtaacggtttaattcttcgtgtgtcatttcccatatcggacttttgcgatgcagttcttgtcaacaacgttgtaggattgactgatgaatgtgtcgatattgtagaataggttcttctcttaagtttcgcctgtttgggatgcgtaccatgctctgattcagccgatgtttcaaagattgcgctaactagcgaagccttacgagcgcttgtaaaagttcttgccgaggaggaggcttctaagttgcatctgttacttgacgtaccggcaggtaacgccgtatcatggcctctctctaaagccgcattctttggcaaagagggagcgatgctctctacatgaatctgcttttggtgagtttcagactttgctagcctggatggcctcgcattagaacttaaaagcgcgaaagatcttaactggtaacgtttcactgcttctgcttctgcttcaccttcaaaatccatgcggccacttgtggatatattcgttttctccacatagcctccattttccactccactattctccccgttagaggaactaaatttgtgtctagaatctttcgtttcgtccactttcaatgcaagcgcttcgtgacgtattggttgtgcatcagaatactgcctatagttctctaattttgggtacttgcctgtcttcatggaagccgccgtattgtcaacggattttgaccttggtaaatctgacgatgaatcaaatgaagtggataaggacgacattacgaagttttttcacgttttctcataaaaattcagtacttctataaaggtgattaaaatatattcctgtcgatttttttatccaactgacagtacatttccatgtaagtaattgtttagcaatagtagtctctaccgtccttgctgaacattgaatagaggaaataaacgctgttgattttacctttccacttttataatataaacctctacgttaaaatatcatatgctcgaggaaaacctgatttctctggaagcagccactttcgtgaacagccaaaccaaatgctgcatttttcgaagaaaatttttatctcaaggagtcgcttttgtaacttatagccggtcaggcagtaaaaacgtacctgaaagaatagtttgatagtaggatatggacaacggttagttttgtctgtacttcttgtatacagggcctctgtcaaatgaatgtgcgtataaattaatggaggtcttgcatagtttgttgaaacttggaagaactgtcaaccttcacatatatgatatccacggtctaagcacgaagggcacttcttgtttctcacatttaggcaactacgatgtgggaagtacagctcagttacggaatctagcacgtaggaagaataagcgataagtgttcccttcaacacatccataaaggagtttagcagctgatatatttgtcgtatctaaaaaaattttcagagtattatgacctcgtcaagtacaacggaaatatatcctgacatggaaagattagccgttcagaaagtggccctgtgcattaaatatagttgtagtttcagccgtctatatttttttttcgaaccatcacttttccctttctggacttttctcaatgtaaaaacaagaaaaacatggaatgtataatactataaataaaaaaagtaggaagaagaaccaaaacaaagggcgttttaaagagagacgaatatgcttggcgaagatgaagggaataccgttcttgaaaagggaaataatccttctgtaaaacaaggagaggttggagctgtatttatagtacccaaaatacttatcagagaacatgaaagagtgatacttaagcaaattctgcaaatcctggatcaagatgaattggttcaacctcccttagacaaatttccctacaaaaaattagaattaccgaaatatatagatgaacttaagacgagagacgctactaatacatcctacaagatgatacaattggatgcttatggtgagaaaaaagtgggttcgaacggtgaattatttggcggtagacattatttgttcaacaccttcacattcacggctcatatgggtgttcttctggtacttttacaagatgtcattaaagtgttataccaaagcaacgcaacgcatgacgaggacgagtttattgtccagcatgatcaaattctggtaatggaaacttctgaggaacaaacaaaatttttggccaaaaatggtgtcattcctgaagaatccaaaggatcttttaagtatataactgccaggtcagcctttgttgaattcggtgcttctgttattgccggtggtcaacgcatcgttgatgattattgggaatctttagctaaaaagcaaaatttgtcgtctcaccaaagggttttcaaattatcaacaaatttaatttctaaaatctcacttttacgcccctccttccaaaataacaggattagcaatgccaatgaaattagtgcgaacactaataatacctgtacgatttctacttcaaaattcgaatcacagtatccaatagtcacggaacaaccgtcagcggagattagagaagcctatattgaaaactttgccaaaggtgagcacatttcggcaattgttcctggtcaaagcattagtggaacattggaactcagtgcacaatttagagtaccgcgttatcacagcaaaaactcatttcaacaagctctgcaaatgaaggcaatggacataccaatcggaagacatgaagaattacttgcgcaatatgaaagtcaagctcctgatggttccgcttcaatttcacttcctaaccatattccatctgtcaatcctagcaataaaccaatcaaacgaatgctaagtagcattcttgatattaacgtttcctcatcaaaaaacaagaagtctgaggagaacgaaatgataaaacccatgaacaagggccaacacaaaaataatacatcgttaaacataaacggctggaaatttgaatctttgccattaaaatccgccgagaattcaggtaaacagcaatattatagaggattgccgttatatgaaaaaaacacgctgctagaaaggttgaaacagctgacaccgaacgaaattaaagaactagagcatttacacgatgccgtttttgttaataccggtttgcagaacgttagaaaagttaggacaaaaaaatggaaaaagtactggcagtacaaggcaggtattcctatcggtttgaaacggtctcaattggatgaattcaaaaataaatatttgaaagatgtgttggcgcaaacgagtgttactacaaattttaacgaaataacgaatacggatgaaacaataacaacaaagagggtaccgaacccaaacttcctaggaaattgtaacattaaggattttaaacctccatacatttattctcatgtgaacaaagtaccacaaaatgtcgctggggataaaacggctgttaagctggacactgaagtaaagaacacaaatgctaatccagtggtggcgacggatccggtcgccgctaaaccggacaacctggctaacttcagcaacgaagtagctatgaataattgaaagaagtaaaacataatgtagggaacactccaataagaaataaaccattgttgaagtagtaatataaactatcgttcgttattttataaaatatgtattgttacatatatatacatatatagggaatgcatgtgcacaattggtttgagtggaaggaataatccaaaatcatagcagtttggtctttatgatctcttgtctgattctgaatgtgtaatatgccataaccaacataatgaaaattaatggaagtaaccaaatcattagttttctggcaatttcgtcgacctgaggaccatcttgtccatgacgtttggtagcttccctatacttttcttgttcaaccaggactttctccaatttctgattgattgataagaagtctttgaaattttctttatcctcagcgattgcatcatcggtggacgttcccttttcattattagctggtggcttagaagagagctgtttagttatcgtagtcatgaatgataatagctcttgttggaccttaatgacatcatttagctttgtttctaaagcattgatatcgttcgcaagaattttaccttcaactctatccagtttcttatacaattcatagtttgtaattttgtctttgtcagcgtcaaatgctgttttttcaatcaatttttctttgccggtttgttggtcaatgtatttggtgatcagttttggctgacccattgcattcacattagggatcaaagaatcttcaatcacgccattaaaaaattgcattttgaatatttcaaaagactctgcattattattcactgctccattttgagcggtgacaccaatacggtaagacccagagggaaagcgaaccttcctagtttggaaacagactttattgtccacctgaacttttaataagttgtcgtcttccaaatcataagttactctgatcgtggaaggaacggaggaatcctgataacccatcaaacaagatgcaaaactctgatcatagattttcgtcttatctacaggcttttgaccatcatttagttgaccacgaagtgttgggcccaatggaccattgttatccactaataattgtaaaccatcatagttcactggcccattgtataactgcttatcgcgtggtacgttagaatcttgaacaaaccaaaatgatatgccaccgtcggtttggccagaataaccaacactcctaaatgtccactccatagtaaaagaatccttcaaatcgaatccttgcttcaaccaaagtgaacccttggaattttgcttagaagtcaatacaattctcccttcctctagactagcttgttctccagtttgccagttattgggcactttacgtgcattaatgagatcagggagcgagtagtctgagcttaatttggatgcatctgaagtgtcacccaatggatgagcttctagcaatccagcccatgtcgctaagacggtaaaaacactcaacagtactgtacttttcatagtaattaacatcatcataaaatacaaattccctgatgctaactatttgttaattttattggtataattataattattcaataccaattaaggcttctattaaaagatcaaaaacattcttaagagttcatactgtttctctactcgtgtatagtgataccaagacgtaatgacaataatagatggaaattgaaatattatgaaacaggaataatattccgttgaattgtaatagatgttgtacacctgcaagcgagcatgctatcattttgcgactatttttggtctgaagaccttgtctcaggtctagatgtgctttttgatagattataccatggttgtgagcaatgcgacttgttcattcaattatttgcgtcaagaatgcaatttgaagtcagtcacgggaggcagttgtttggtatagaagccggtatggacaatctgaaggcagtgcaggaagatgaagatgaaggggtgacagtttcgagggccctgaggggaattctacaggaaatgtctcaggaagggacgcatcacttgacaatagcgtcgaacatagaaagtttggtgctgcagccattcagtaaatggtgcatagaacatagggagagaattcaatactccgagaagactttgttgaccaatgtaaataatttcaggaagtctaaaaagtacgtcggtaagctggagaaggaatattttaataaatgtaggcagctagaagaatttaaaagaactcatttcaacgaagatgagctagcaaatgcaatgaaatcattgaaaatacaaaataaatacgaagaagatgtggccagggaaaaggatcacagatttttcaacaggatagcgggaatagattttgattataagacaatgaaggagacgcttcagctgttactgaccaagcttcctaaaacggactataagctacctctcattagttattctttgagcaacaccaacaatggtggagaaataacgaagtttctgcttgaccacatgtcgttaaaggatattgatcaagctgaaacgtttggccaagatttgttgaatttagggtttttgaaatattgcaacggtgttggtaatacatttgtcaactctaaaaaatttcaataccaatggaagaataccgcgtacatgtttgccaatgtgccaatgcccggttcagaggagcctaccactggtgaatccttaatatcccggttcaacaactgggatggttcatctgcaaaggaaattattcaatccaagattggtaacgaccagggggcagcgaagatccaagctccgcatatatccgataatgaaaggacgcttttcagaatgatggatgcgcttgcagcgtcagataagaagtattaccaggagtgcttcaagatggatgccttgagatgctcggttgaggagttgttgattgaccatttgtcgtttatggaaaaatgtgagtccgatagactgaatgcgatcaagaaagcgacactagatttttgttctaccttgggtaacaagatttcttcgttaagactgtgcatagataaaatgctcacgctagaaaacgatattgatcccactgcagaccttttgcaacttttagttaagtacaagacgggcagtttcaagccgcaagccattgtttataataattactacaatcctggttcatttcaaaactttggtgttgatctagaaactcgttgtagactagacaagaaagtcgttccgttgataatttcttcgatattctcatatatggacaaaatatatcctgacttacctaatgataaagtaagaacttcaatttggactgattcggtgaaattaagtttaacacatcagcttcgaaacctattgaacaaacaacagttccacaacgaaggggaaatatttgatatactttctacgtccaagttggagccaagcaccatcgccagtgttgttaaaatttatttattagaattaccagacccactaattcccaatgatgtctctgatattcttcgggtgctttaccttgactatccacctttagttgaaactgcgttgcaaaattctacatcatctcccgagaatcagcaggacgatgacaacgaagaaggctttgataccaagagaataagaggcctttatactactctgtcctctctaagcaaaccacacatagcgacactagacgctattacaactcatttttacagattaattaaaattctgaaaatgggagagaacggtaatgaagtagcagatgagtttaccgtctcaatttcacaagaatttgccaattgtattatccagtcaaagatcaccgatgataatgaaattggttttaagattttctatgatctactgacacataagaaacagatttttcacgaattgaaaaggcaaaattcaaaaaattaggactaggcgatatagatttgtatataattttatataaaaggaaatatgtacatcattttctttcactgtaggcagctgtttcaagttctttttttattggagatataattatttacattattgttatagaggacacacgaaaaagcaagaagggaactataagaaaaataaaaaataatgaagaatacagatctgtaattagtcatttcaagtgagcgtaataagtaaagtaaggtagaacggaataaaatgctcaagcgtattgttggattgcctgcaaggcgttgctttcatagaacgtcctttttgctgggcagtgactttgaaactgtgcatattcccaatacgaaccactttaaagatttacttatagagaacggtaaatttcaagaggatcaagcaactacaatagtagagataatgacagatgcaattaggggcggggttaatcatgtttcacaggatctggcaaagagagaaaaattgacccaacttagctatcaacaacgtgttgattttgcaaagttaagagatcagctattgagtgctgatagaagtgaatttcacaatattcaaaacgagtacgaaagtgtgaaaaacgatctggagaaactaagaaacaaactaagggaagaaattaccaaaacaaacgccggtttcaaacttgatctgtccttagaaaaaggcagaattagggaagaaagtagtcatcacgatctgcaaataaaagaaatcgacaccaaaattgagcaagaagtgaccaatatgaagatgcagattgattctgtcaagactcaagtcatgcaatggctgataggtgtctgtacaggtacatttgcacttgtattagcatatatgaggttattaacatagtggcgacaagcgaggaaaaagggctagacttggtacttgaaaattgcatttacgttttgtataacacagttcagtaagagtacacattcaataacgtagtaagagtatatttatttatataagaaggataaaaaagaatcaccaaacggatcacaaatggcataatcacgtagcaacctggaaataaagctataagttgaatagttcagtcaaaattttgacggtgtcatcaggggattgtactgaatgtccgatggttctttcatcgacaaaaatttcgtaatcgttaccaccgaccatagtcttgtcaccaaagaaatgaatttccttgaaaccatctttttcaacgtgttgcaaacagtaggtcttatcccaaccagcggggaaaacgtcgaaagagatttggccaccaatggagaaagtcaaaccgtagtctgggaattcctttttcaaagcttcaacgaacttggctctgatttggtgttccttatcgtatctttcgaattcgtttctttcctcagtagaagcatttctaccaattggggaaacgttgatcataccatttctaaattccaagaaagtacctcttctctttggcaagtcaatttcagatagatatctcaaaatgaagacggccaatttattgtatttttcctcaccgagccagttgatgaaggattgagaagctaattccttacctaatctgtaggcggtcaaaccattttcagagaaagaatagtcaaattcatctaaaacgtttgggcctaactgttctaattgcttgcttaagtcagaaccaccgacaaaaccaatgcagcacttgtttctcaacttggccaaagtttttctaacttcttcagaaacagttaatctggctggtgtcaaggtaccatcaacatcgaataaaaccaaagtttctggtttttccttgtaagcgaattcagcgatactcattattggtggttatattagcagataggtaaaaaaggagaaagaagtactaaggaaattgtcgatttagttttcgtcaaagatcttatactttgccaagaagaatagacgatataaacagaaaaataagtgaaaagaacacgtaaaaaacggcacattttaatatatttcaaatttttttttcatcaacgacaaaaggaatgcattttatccacttttcgtgtctcatgacgagtataccgataaacgccaaatgcgtattttattatctattttggccaaaatcaacgtgtcccgtggattcagcgtgcctagcaacttctctttcacccacaaaggtcatttggcaagtgttgcatttgatctgggccttatgagtgttgaaggaatagccagtttgcttcaaatttgaggccagttgcaaagctgctgttagaacatcatctgattccggctggttcttgttgaaaacagttttaaactcgttcatggtcaaggaatcatagtggattccgttgaacagtatcaaaatgtagttgtcgaacttgtcctcgttgaacttttcgattttaacagcgtcaatgtcgactacataaatagctactgcgagtgcatcggatatgataccaatctcgatggctccaccccaagattccattttcaaaatccattgcgcgtaatctttgttaggtttgtccaatatggcgtcattgaacttgacggggttgttgaggacctccttagagaccatctccctgaggtcacgaacgctatcttgtttgaagatgccataggcaatagcatggaacagacacgagttgtcgtcgagaacaggatgtactgataggacgttttctccactgccaccaattgacatctcagtgctcttcagcaccctctttggtttgggttgtggtggtggcaaactgaagctttcgttactatcagaggactctattgtaatcttttcaccagagttaatacccagctcgtccagctgggtttgtcccaaagaagcgtcttccccttgcaaattgatcctttgaggcggatatccaaacctcatcgtcttaacatctacattgatatgctcaataagatcatttagtgttgcatcttgcttcaaagtaacgacttggttgattcctgctccagtaactttcagtttcatcttgaaagtttcttctcttggttatcttcttcaatgttatcttgttttcaaaggaaaaagttgttatttgccactgaaatcggcttatttcgccctttactattagttactaccattgccctatagaaacgatatatattggtacgaagaaaatacagatcacaacttcagttctaccaattgcagcttcaccagttgatgtaatgagacagcaattgaacgtatgtagaacagattaaacaatagcaaaacgaccacaatcaagtataagaacaaccatgtttccatggtgaccttgagaccttgctgctctgcaattgcgggagccgtaacaaccgcttctcttggttgttcaaggtcaacctctttcaacttattttttacttctttatcatcttgctcctcttcctccttgctgatagtaatttggcactcttcgacattgttcttgatgaacttggaaagaatacgctccattaattgcgcagcctccaattgaccattcttgcatccattttcaaccatacctttgatccaactggaaccagtccattccacccaaaaggatacccgtaacagacacgttatttcgtcattccaacggattagataccttgtcttagttgagaaactaccaccactgggcacgttcggagtgcgtatgctactgataacctcatagtaagtatcaggatcttttctctttattacctcagcaacataacatgtcgtggacttgggccccgcaggaaagtgcaatgctttctcgtatgaatactcacgcttcaaagtcatggaagatccgtcaatgctcgtgaaatttggaatagtggtaatttgtgaaccttcttgaccccgtaaaaaatctagaagaaattcgttttgctctgagttgaacatgatctcaaaaagtataccaggtgcacaatcgaatggtaactccttgagaacaaactcgttattggccataggttcagccggaaagcttgttgaatgatgatatattggaccatcatactgatacgaggaatcggcacgcagtttatacgctttctctttttctttatccggcgaggaactcgtactattgggggtagtctcatttgtagagatattttcatcgtcattttcattagtgtcattatcattagcgtctttatcattgttttcctcatcgatggagtttattgcatcatcaatctctttgccatttcctgacttttctgctttagtattgatgttttcgctggccatgtccttctgcaacaaggttcttgaccacacttctttcattaatccaaatgcagcatccctggatataaaaccattaaagagagttttgcccatctttgtttcgatggatattgcgctggggaacaacccagcagcagaagttttttccataaacgtgacatcttcgaacgcaatcagtactttagcaatccaaccaagaacattggagttgaagcagagatgcgtttctgttatgtatagtttcccctggtaaagcagctctctattcagcccacaattaaaatcatccagtagtctgtcatctttaggaacggacttgaatgtctcatgaaagtctttatttctttgctcagacgcatagtgataaggtgtgtccatgtaacgttcttccacgaatcgtctatgatcgtaattgtcttctttcatttgggaaggagtgagtcttgtcttgacctcatcaggcttttccacctgttgcaagggagagcctatttcagcaattgtggcattactgatacggcggcttgatcttcttttggaccccatggaaggctcccttctatgtgatataatgcttggttgcgaaactggcgaagttggcgtagttgatctagaaactggggatggcacgtttgacttaaacgaagagatcattccactgaagaacgaggacgtcgaagaagtccttgattgatcgtgcttgatctctgtagggtgttcatcggcggcactttggtttgtaatcactactaaattcttgcgtacgtcgttggtctctgtatttaggggcacttcttgcagtgactcagcttcagtatcgccggcattgtcattgttacttgcatgctcaaaggggggacccaattgtttcacagaatcagtactgtcctcattatctgatacgggttcccagttatctacatccgacatcaccactaatctttttgtgtagttgccttcttcacccttttctcagatagcgaaatggttgagtgttttaatataattgtcaagatgctttatgaaaaagggtgggagaaacaagtccccctgctcagcgatacgcgatctctctgatctcagacataaagcaaacattctatcatgagtgacattgaggatgacggtaattggtaatatctgaccttctgacctccactcaacacaatgcagaaagctatcaaatgttttgaaccaaacatgaaagagattcagaaagttgccaagccaacgtgatgtcacaggtcaaagtttaagtgaaggctattggaatctgcggatcagacattcactactacacggatggccaggtcagcgtaaagtaacctgggaagcccatgactttgggccacgaatccaacggtgctgttcttgaaattgaagtatctcaaactactgtaaagcgggtgatgcagtaagcatatagccctcatacccaaataggtttaccaaagagtttctgtgaggccattatagtttgcagctcaacataccatttgctgcatcactgaccgtgacggcaccctttgtcaagagttcgtggttaacgtcgactgcgtttactgattaccgttacagtgaatttctagcaagagtcctctgtagatgccactatttgtcgctctccatgtagtaaggccgtcctagctgaagtgtggggagtaagctgtagttataggtgctggaacaattgatctgctggcgggtgcggtactcagagggtttggtgttcatgagtacacatgattccaagaaagagcaaaatggacagtttataaacgctatgaagaactgctataatcagaaaaaaaggaagcctgatggattcgagtcctcaggtactcaaaagagcgttgagaatatgctaaaatgtgtcaagaacggtggaacagttaagtaggttgatatccacccctcgaatgaaaatgtggggaccctcccaacgagattccttcagagagattacatataaagtgaaattcaagtatgacgatggtgactactccttggccattgatttgatgtctagggattgtattaatgtctatgagttgattaccgataggctactggttgatttcctttcaaaaaagctgctcaagctaagataggtaaggtgtttatagaatttatcgaactgtatctaaatatttttaatattcttgttttattactttgtggcttttgtattcagtctgcaccctgtttcgccatcgattcttataatacatacatttttatataagatcacagaaaatacgaagacgtaaaaaaagagttccgaatgaaagaagaaagaatcaagcacaggaagacaagaaacgatgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatggtccttctatggtgacacaatgtcccatcgttccgggacaaacatacctgtacaacttcactgtcccagagcaggtaggaacgttctggtaccatgcacacatgggtgcccagtacggtgacggtatgaggggtgcatttatcatccacgatccggaggagcccttcgaatatgatcatgaacgagtcatcactctatcggaccattatcacgaaaattataaaacggttaccaaagagtttctgtcaagatataatccaaccggtgctgaacctattcctcaaaatattctttttaataatacgatgaatgtaactttagattttacacccggtgaaacgtatctcttcaggttcttgaacgttgggctgtttgtatcccagtatatcattcttgaggatcatgaaatgagtatagtagaggtggacggtgtttacgtaaagccaaactttactgattcgatatatctttctgcggggcaaagaatgagtgtgttgattaaagctaaagataaaatgcctacaagaaactacgctatgatgcaaataatggatgagacgatgcttgatgttgtcccacctgagttacaactcaaccaaactatccaaatgaggtatggccactcgttgccggaggcacgcgcattgaacattgaagattgtgacttggaccgcgccacgaatgacttttacctagaacctctgattgagagagacctacttgctcactatgaccaccaaattgtcatggatgtaagaatggtcaacttgggtgatggtgtgaagtatgcatttttcaataatatcacttacgtcacaccaaaggtgcctactttgacaacgttgcttacctcaggaaagcttgcgtcagatcctagaatttatggtgataatatcaatgcgcagttattgaaacataatgatatcatagaggttgttctaaacaattatgattctggcagacatccattccatttgcacggtcataatttccaaatagtccaaaagtcgccagggttccatgttgatgaagcttatgacgaatctgagcaagatgaaatgaccgtcccttataacgaatctgcgccattacaaccgttccctgagaggccgatggtgagagatacagtggttcttgaacctagtggacatgttgtcctgagatttagagctgacaaccctggtgtctggtatttccattgtcatgtagattggcacttacaacaaggtttggcttcggtctttattgaggcacccgttttacttcaggaaagggaaaagcttaatgagaactatctggatatatgcaaagccgctgatattccggtagttggtaatgctgcaggtcattcgaatgattggtttgacttaaaaggattaccaagacaacctgagccactaccaaagggatttactactgaaggatatttggcattgattatttcaaccattatcggtgtctggggcctatattccattgctcagtatggtattggcgaggttatccctaacgatgagaaggtgtaccacacgttaagggaaatcttggctgaaaatgaaatagaggtttctcgcggctaattaaacaagaaaatataaaagaaaaatgaaagaagtttatattcatattgatgatttgcaatcctaaaaaaaatgtagcactgtaaatactgcttactattgagtattttcattttgttcattccattccctatataatattcatacgtaatcaaatctattgctttttttttctcttttatttcgttgttttagctctgacgttgtgacgctcagccaagaacgtcacaaaaaaaggatgaaaatcaaaaaacaaaatattcaataagtgtaatatgagaagagaaaaaagaaagaacaagtacagtttctaacattatactttaaaaattattaagcacaatgacagcaatgaaagctattgtctggagacttcccaagatgccgaaaatcaaaattacaaaaacttatgaagttacgaaaattacggcgatattgacactagtaggatttataatgggccttgaggtgccgtcattggcaacttttctcacaaacaaaacgtttaatgagtacttcaagtatccaactcctttacaacaaggtttactcatggggtccacccccctgggtggtatcatgggatgttttatttgctgcataatgaatgatagattcagtagaatatatcaatttcaatcgggaataataatatggaatattgttacgttattgaacttttgtatttgggatatattaggtttactaatttgccggatgatcaagggtatgatccttgggaacttttcaattttagtagcatcctacgcaaatgaagttatcccccgcggcaagcgtggaagtacgatgagctatattcaattgtgtttaaccattggaattcttgttatgcattatttgtgcattgcattaagtctatgggattctcattttgcgttccgtatagcgtggtgcataggaatcattcctggattactgttctggatggctagctacgctctacctgaatcttatcactggctagtactacatgggaagatgagtgaagctcaggaaattcagcacaatttagccaaaaagtttaatgaaagccagccaagggatgcagtccctgagatgagtaagatcgaattagcaggagatttttggattggagttaatgatttggacttctccaaaaaattacctcggggttcgtttaagcctttgattcttggaatgactttacagttattggttcaatttagcggtataaacattatccttggttatattacatacatttgcgagattgtagggcttgaaggcaatgtaaaactattcaccagttccattccatatttcatcaacatggttttgagcttgttaccgattacattcattgattacactagcagaaagctaattaccttgttgggtggctttcccattagtgggttgctcattacaatcggcgcattatttgtgaagtatggtcaagacaccaagcccatcgacggcaataggagtttagtttggtcaattggagaaaacccgtttgtgggaggatggattctaactttatgctttctaattgttggaatatttgccatgagcctttccagtataccttgggtttacacgaatgaaatgttgccctcacgagtgaaagttaagggatttgccatttgcgtaacgtttggatggttgggcaattttattttaacgtttctatgccctgtgatgattgaaagattaaaaggcacaacatttataatatttggatctttgacattcttgatatcactttcagttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatgatacacggtccaatggataaacattttttatcaacactatgatatataaatataatagtttttcgtatatatattcctttttttggtcaatttttgaaattttcgtagaaaagggagagacaaaacacattatatcaatgaaaacgtacaaaaagtagataaagtcagtgcttaaacacgtcttttccttaaaaatactttattatttttattttattgagagggtggtttaaaaatagaaatagagagagaggtacatacataaacatacgcgcacaaaagcagagattagaaacacttgtggtgaacgatagatggaccactttcgtcgtattcttgttttgagatccacatttgttggaaggtagtcaaagaagccaagatagaaccaccaatccagacggagtactttctttctggaggagcaatgatcttgaccttcatggaagatggagccaaagcggtgatttccttttgcattctttcggcaatacctgggaacatggtggtaccaccggacataacgatgttaccgtataattccttacggacatcgacatcacacttcatgatggagttgtaagtagtttggtcaataccggcagattccaaacccaaaacagaaggatggaacaaagcttctggggctctgaatctttcgttaccaatagtgatgacttgaccatctggaagttcgtaggatttttcaattgaagaagattgagcagcggtttgcatttcttgttcgaagtccaaggcgacgtaacatagtttttccttgatgtcacggacaatttctctttcagcagtggtggagaaagagtaaccacgttcactcaagatcttcatcaagtagtcagtcaaatctctaccggccaaatcgattctcaaaatggcgtgaggtagagagaaaccagcgtaaattggaacgacgtgagtaacaccatcaccggaatccaaaacaataccagtagttctaccggaagagtacaaggacaaaacggcttggatggaaacgtagaaggctggaacgttgaaagtttcaaacataatttgagtcatcttttctctgtttgatttagggttcattggagcttcagtcaaaagaacagggtgttcttctggggcaactctcaattcgttgtagaaggtatgatgccagatcttttccatatcgtcccagttggtgacaataccgtgttcaattgggtaacgtaaagtcaagatacctctcttggattgagcttcatcaccaacgtaggagtctttttgacccataccgaccatgataccttggtgtcttggtctaccgacgatagatgggaagacagcacgaggagcgtcgtcaccggcaaaaccggctttacacataccagaaccgttatcaataaccaaagcagcaacctctaaacatataatatagcaacaaaaagaatgaagcaatcgatgttagtacatgagacttagtaacagtagcaaataaaagaagaatatcactatcacttatcacgaaaatatttctagttttttttttttccaaatttcaagcccctatttattccaataatatcgtggttattacagatcagtcaatataggaggttatgggagagtgaaaaatagtaaaaaaaggtaaaagagaaatctctcgagcaattgggaccgtgcaattcttcttacagttaaatgggatggtgcaagcgctagaacataccagaatccattgttaattcagtaaattttcgatcttgggaagaaaaaagcagtaagcgtgaaaaatctaaaagctgatgtagtagaagatcctattctttaacaaagattgaccttttctttttcttcttggtttgagtagaaaggggaaggaagaatacaagagagaggaaaaaaaggaagataaaaagagagcgtgatataaatgaatatatattaaacaagagagattgggaaggaaaggatcaaacaaacccaaaaatatttcaaaaaggagagagagaggcgagtttggtttcaaaacggtttatttatttatgcaagaggacgtggaagaaaaagaagaaagaagaaaaaaatttgaaagaaaaaaacgcgtggcgggtaaagaagaaaatggaaaatagaggccgggtgacagagaaatattgagggttaattggaaaatatgttagggtgaggcatatgtttttaagggttttgaggatccgataaggaagaatgtaggttaaatgttgtgcattaattgctgtggcagcttacccgcttccccacacattttggtagtatctgtcctcttgttattgttactgtaattgtgtatatatgttctcgcgtgtgtcttatttacttatttagttattatattatatgggtctgcaaggtagaggcgcgcttgttcaacagcagcccccaccggtgttggttaaactctgtcccttcaggttgacgttccctttgtcttccttcttctgagtggtttcgttcaggttttgttgggacatactttccttgatttgtctagccatggttaaaaacgcatcctcgacgttggtggagtccaaagcactagtctctaagaacggcatcttattcgcgtccgcaaattcctttgccacgtcatattccacgacacgcttgtcctttaaatcacacttgttacctaccaatagcttcaacactgttgaggttgcataccgatcaatctcttgcagccacatcttcacgccgttgaaggattcttggtcagtgacatcatacacgataatgatcccatgcgaaccacggtagtaagatgaagtgatagtacggaaacgttcttgacctgcagtgtcccaaatctgtagctttacagtcttgccgtccagttctacagtcttaatcttgaagtccactccaattgtggagatgtagtcgttggtatatgtgtcgtccgaaaacctcaaaagtaaacaggacttcccgacaccggaattcccgatcaacagcagtttgaacaggtaatcgtactcgctattcatattagtgcttttcttgttttatttatttcaacctgggcctaacagtaaagatatcctcctcaaaactggtgcacttaatcgctgaatttgttctggcttctcttctttttctttattccccccatgggccaaaaaaaatagtactatcaggaatttggcgccgggtcacgatatacgtgtacagtgacctaggcgacgccacaaggaaaaaggaaaaaaacagaaaaaacaacaaaaactaaaacaaacacgaaaactttaatagatctaagtgaagtagtggtgaggcaattggagtgacatagcagctactacaactacaaaagcaaaatctccacaaagtaatataatgagagaaatcattcatatctcgacaggtcagtgtggtaaccaaattggtgctgcattctgggaaactatctgtggtgagcacggtttggatttcaatgggacatatcacggccatgacgatatccagaaggagagactgaacgtgtacttcaacgaggcatcttctgggaagtgggttccaagatctattaacgtcgatctagaacctgggacgattgacgcagtacgcaattctgccatcgggaatttgtttagacctgacaattatatctttgggcaaagttctgcgggcaacgtgtgggccaagggtcactacacagaaggtgctgagcttgtagacagcgtcatggatgttattagacgagaggccgaaggatgcgactcccttcaaggtttccagatcacacattctcttggtggtggtaccggttccggtatgggtacgcttttgatctcgaagattagggaagagtttcctgatcgtatgatggccaccttctccgtcttgccctctccgaagacttctgacaccgttgtcgaaccatacaatgccacgttgtctgtgcaccaattggtagaacactctgatgaaacattctgtatcgataacgaagcactttatgacatctgtcaaaggaccttaaagttgaatcaaccttcttatggagatttgaacaacttggtctcgagcgtcatgtctggtgtgacaacttcattgcgttatcccggccaattgaactctgatttgagaaagttggctgttaatcttgtcccattcccacgtttacatttcttcatggtcggctacgctccattgacggcaattggctctcaatcatttagatctttgactgtccctgaattaacacagcaaatgtttgatgccaagaacatgatggctgctgccgatccaagaaacggtagataccttaccgttgcagccttctttagaggtaaagtttccgttaaggaggtggaagatgaaatgcataaagtgcaatctaaaaactcagactatttcgtggaatggatccccaacaatgtgcaaactgctgtgtgttctgtcgctcctcaaggtttggacatggctgctactttcattgctaactccacatctattcaagagctattcaagagagttggtgaccaattttccgctatgttcaaaagaaaagctttcttgcactggtatactagtgaaggtatggacgaattggaattctctgaggctgaatctaatatgaatgatctggttagcgaataccaacaataccaagaggctactgtagaagatgatgaagaagtcgacgaaaatggcgattttggtgctccacaaaaccaagatgaaccaatcactgagaattttgaataattaagttgctttcctttctttttcttacctttcttcttctctaggattgaagcacttggagcaaaataaacaaaaatcaaaaaaactaattaaatatctttaaaatattaccgtacgaaaaaatttataccattccctactgaagtatgtaattcaaaatatatatatgtatatgtatatgtacatatatatgtatatactatcttaacaacctttaaccttccgagctattgatttttgatcctcacttcagcggctaaaaaaaaaaaaaacaccccgagtattagtgaatatagatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattctacctgtttccccagaattttgttgagaactaatcatgaacaaaaaactgtgttttatattgtgatttccataattccattacaattttgtaccaagcataggtctgattatcaacaatacgctgcttcagtccttttatttagcagtacgttgcttgttattccttcatcatctagccgccatagttggaaccccgcgtgaaaaatgatatacatttcgtattcagtgatctggggttgcatgaataaaaattctgggtaaattgtgggtgggtacactttggcaaaggctaaccccgaatttttcattatttcggttttttttctttttaatttcaagaaaatggaaaactttaagaataacgacgttgattttagcctctccgtgaagatattggtaaaaagataggtgtcgtcgattatagccaccagcttttacaaaagataccaccagcttgtgaatagtttttaagaaagtcgctttaaaaggactacctaccccagatcagaaacaaaagcagatctcctgttcatataccatttgtattctgcttctttacattttatacattccttggatcagttcctccccctctttgatattcactcaatatgctgagaccggcctataaatcgctcgtgaaaacatccctgttacaaagacggttaatatcttcaaagggatctaagctgtttaaaccatctccggactcaacaagtacaatattaatatctgaagacccccttgtaacaggctcgtccccaacctcatctacaacatcaggtataataagttcaaatgatttccctttgttcaacaaaaataggaaagacgccaagagcagcatatcctaccaatggaaaaatccttcagaattagagtttgaccctttcaataaatcgcatgcctcagcagtaacctcgatgacaagaactagagacgttatgcaattatggtctctgttagaagcatgcttgcaatcgaatctaatgaaaagagcgttctctatattggagtcactgtacctggtacctgaacataagcagcgatttatcgaggattataacatgtacttgaattcattttccaaaaatgaccctaatttccctattttaaaaatgaacgaaaaattaacaaatgatttggagacaagttttaaagacgttaattataatgacaaaactttggcaataatgattcatcacgctttgaacttccattcaacgacaagctcgatgcttttgaagcctataatctctgcctacttgaaaatgagcgtgaatggtattagggaaattttctcctgcctagatattttgaccatttcagatctgaatattttaatgaatgacttaaaggttataacaccatcgcaactgccaaattctgtaagaccaatattagaatcacttacgctatctcctacacctgtaaataatattgaaaatgaggagggtttgaacaaagtggaagctgagaacgattcaaaattgcataaagcatcaaatgcaagctctgattctataaaaaaaccttccttggatcctcttcgggaagtttcattccacggttcaacagaagtcttgtcaaaagacgctgaaaagcttatagctgtagacactattggaatgagagtaatccggcatactttgctgggattatcattaacgccggaacagaaagagcaaatttctaaattcaaatttgatgccaatgataatgttttgaaaatgaaacctacgaaaaacgacgataataataattctataaatttttttgaaatttacaattcactgccaacattagaggaaaagaaggcattcgaaagcgcattaaatatatttaaccaagatagacaaaaggtacttgaaaaccgtgcaacggaagccgcaagagagcgttggaagcacgattttgaagaggcaaaagctagaggtgacatttcaattgaaaagaatttaaacgttaagttgtggaaatggtataatgaaatgttacctctagtgaaggaagaaattaatcattgtaggtcattattgtcagaaaagctatcagataagaaaggcttgaataaagttgacacgaaccgtcttggatatggaccatacttaaccttgattgaccctggtaaaatgtgtgtcatcaccattttggaactattaaagttaaattctacgggtggtgttattgaaggtatgaggaccgcaagagcggttatatcagtgggtaaagctattgaaatggaatttagatccgagcaggttttgaaaagcgaatctcaagcgttcagagatgttaacaagaaatcaccagaattcaaaaaactggtacaaaatgctaaatctgtattcagatcatctcaaattgagcagtcgaaaattttgtggcctcagagtattagggccagaatcggttcggtattaatctcaatgttgattcaagtcgctaaggtatctgtgcaaggtgttgaccctgtgacaaaagctaaggttcacggtgaagctccagcttttgcgcatggttatcagtaccacaatggttccaaattgggtgtcttgaagattcacaagactttgattcgtcaattgaacggtgaaagattgattgcctctgtccaaccacaattattaccaatgttggtggaacccaaaccctgggttaattggagatcaggtggatatcattatacacaatctacccttttaagaacaaaagactcacccgaacaagtagcatatttgaaagctgcttccgataatggtgatatagaccgcgtttatgatggtttgaatgttctgggtagaacaccgtggactgtcaacagaaaagtttttgatgtggtttcacaagtttggaataaaggtgaaggtttcctagatattccaggtgcacaagacgaaatggttttaccaccagctcctccgaagaactccgacccttccattttgagagcctggaaacttcaagtcaaaacaattgctaataaattctcttcagatagatcaaatagatgtgatacgaactacaaattggaaattgcaagagcatttttgggtgaaaagctgtactttccacataatttggactttaggggacgtgcttatcctttgtctccacatttcaatcatcttggtaatgatatgagtcgtggccttttgattttttggcacggtaaaaaattaggaccttctggtctcaagtggttaaagattcatttgtcaaatctgttcggatttgataagttacccctaaaggatcgtgttgcatttactgagtctcatttgcaggacatcaaggattctgcggaaaatcccttaacgggagatcgttggtggactactgctgataagccatggcaagcattggccacatgctttgaattgaatgaagttatgaaaatggataatccagaggagtttatctctcatcaaccggttcaccaagacggtacttgcaatggtttgcaacattatgctgccttgggtggtgacgttgaaggggctactcaagtgaatctggttccaagcgataaaccacaagatgtttatgctcatgttgcaaggttggtgcaaaaaagattagaaattgcagcagaaaaaggagacgaaaacgccaaaattttgaaggataagattaccagaaaggttgtcaagcaaaccgtcatgacaaacgtttatggtgttacctacgtcggggctacttttcaaattgctaaacaattaagcccaatatttgatgatcgtaaagaaagcttagacttttctaaatacctaaccaaacatgtttttagtgctatccgcgagttatttcatagtgcgcatttaattcaggattggttaggtgaaagtgcgaaaagaatttccaaatctatcaggttggatgttgatgaaaaatcgttcaagaacggtaataaacccgactttatgtcatccgtcatatggacgacaccactaggactaccaattgttcagccatatcgtgaagaaagcaaaaagcaagttgagaccaatttgcaaactgtctttattagcgatcctttcgctgtcaaccctgttaatgcaagaaggcaaaaggcaggtcttccaccgaacttcatccattcgctggatgcttcacatatgttgctaagtgcagcagaatgtggaaagcaaggattagatttcgcatcagttcatgattcttactggacgcatgcatctgatatagacactatgaatgtggtgttaagggaacagtttatcaaactccatgaggtagatctggttttaagattgaaggaggagtttgaccaaaggtataagaattacgtcaagattggaaagttgaagagatctacggatttggctcaaaagattattagaatccgtaaagatttatccagaaaattaggaagaagtactacattagcagatgaaatttattttgagaaaaaaaggcaagaattattaaacagccctctaatagaagatagaaatgttggtgaaaagatggttacaactgtatcattatttgaagacatcactgacttggacgcacttgaactagaaaacggtggagatgaaaatagcggtatgagtgttcttttaccgttgagattacctgaaatcccacctaaaggtgattttgatgttacagtattgagaaacagtcaatattttttctcgtgagccgtgaactacaaactaaaatttatttgtgttatttttatttaacttgtacatatatatatatatacatacttagcgtttatcgtttgcattatttttcattctttttaattgtttatattaagtgtctaaaataggagtgacccatggtaactaataataataattgtgttcacctctaattataaataattttgccctgtttttcaaagctttcaattaacggtagcagcggagccatttcctttctgtcaatgatcttaaactcctttgcaaaactaatgaaatgagagaaaaatgaattccaatgagcttctaatgacaagtgcacaattttgtcaaagtggtggtgataaatatgtgcgaatatcctgaacatctgtaccatgattctctgcacatctctcgaaaattgctgcgggaatggtagcccatttttggtcggaaacaagtttttatcgttcactttgttatttatccacgtgagggccaaatctatgtactgactagctggcagtgaaacctgtctattgtttgcgtccagccataaataatccgtgtgagggccagcgttcattgttggatacgcgtcaggcgttacgtactccgctactactccgtaaaattggttcaagtttgtgaagaattcgaaaacgttcaacgctatccactctcccaggtccacatatttgggcaattgtactattgttttaaatgaacctttcactaaagcagttcttacgaacggttcgctgagaaacattatctgttgtgattctgatctctcactagcttcttgctgttgagactgtggtgtggtagatgtcaattgctgtgattgcggcgtagacttttgtgcggggaaacttgtttgagaatgcctcttaggcgaatgatgtttatttcttaacgataatctggaattgctgctgtgggggcttgaataaatggtgttcattgctggcggctgagcaacattaaggggctggtttttatttttctttgagtttcttccgaatgctctgttttgcaaagtatacacgtaggatcaaatgatttgattaggtgtgttggctagttagtaaaatgataacgcaggtccagaagaaaataaaacgacaacagtgtgaacatacttgaagttgaagaaggacatgatgtgctgataaatgcttggttggcttgcggaattggggtagttgcttttcttaaagttttttgatgatcttcgtgtttcaaaagctaaagcatttctttttcttttctatttttcactaattttcgtgaagtgacatattgcaaaaataaaatatgtaaatcaaaagagggacaaaaggatatattaagggtggtgaattatgatatgaatagcattttataaattaatatacatgtgagtgtctatttattcgtcatcctcttcttcgtcagcatcttcaggggtgacttgatagaaaaccaatttgtattggttttgccttatagagacgaatctgatccagtctcttagctgattcttcttcaaatacttctttgttagatatttcaagtatttaccagaaaatttggcactggatactacagtgactatagaaccatcttcagtaacctcaatggcgttccctaagtttcctacggcaccatctactttaatatgatcgattaagtacttggaatatgaagccggatcgaagactccgttttcagttggagaggaaacgtcaacggttaaggttttgataactttttgctttctggaagtctgttacagttttatgttagtaatcccaactgagatgaaatcatccttgtcgtttggacgaggaaaaaatgtctggcctactgctattaacaatcacttcatatagctagagaaagcgcattgcctctgttaaagctataaggggtgaatttttaaaatacagaatagctgaatacataaaaatgtaacttcgagatggaatccactagttcgctgtgaaagcgggactgttcaatgaactgtaggaatagacaaactttttaaagattttattttctttcatgttctctaattgtgacataggaacgaaaattaacgtacgtttggagccattgtggttgatatttgtgaaacgatataggtttactgtgctacggtgtttttatgatcccagatgttcaaaaaaaatcaataattatcaattaatcgtgtactttaataatccatatatgaatcatttaggtaattagctcttttttgcttgaaaaattcatccattcggctcgcgttgtctaaaaaaaaaagtttggaaacttttttgtataatttatgggtgttatctctgaatatgtacgggtgttgacatggagaaagcagtctcgatattttgccgaccttaatgctttaagaatatgaaaggaaatgcggtgcaaataaacgatcctatcgtggtagtaggaaagggtgtgtactactaatagagaattataccatacgctagtttgtttccgagtttgaatagcttcgtattttccttactggctggtacagttagttttagtgattctattagtgattggaaagcatagtggaagggtttctcgaacgtaatagaggcagagttaaaagagaagattaaacattacagtactaaaagatgtccgattcggaggaagatttaggtgtacagttgaaaggcttgaagatagcgaggcatttgaaggagtcaggggagcatactgatgaagaatccaactcaagccccgaacatgattgcggcttgagtaatcaagatgatttaactgttatgcatacacaggctaaagaagaagtttttaaacgaagagaagaagacggaacacgaaccgaagatgctttacatgagggagaagcaggaaaagagggcacaggttttccctcatcacagtcagtgtgcagtcctaatgaagcagatagcggtattgatcgggccgataaacctattttgctggacccttttaaatctgtgcacgatacggatcctgttccaggtacaaagtccaggagcaattcagactccgactctgattcagatgatggaggctggcaagagatgcccgctgtctcatcgttcaatatatataaccacagaggcgaactagagttgacttccaaggttagaaactcagaacaagcctctgagacgtctcccacagttcctccaggaaaaaattgcaaaagtgtcaatgattctagatttgactatacgaaaatggccgctgagcagcaagcccaacgatcctatcgaacaaataaaaaaacagatttcctttttgaccacaaagtactgaaaaagaaaattaacagttcgcaaacttccgtaaatttgacttcttccccttcgactacatccttgaacaatgaaaaaaataatgatgacgatgatgatgattcttatgacgaatatgaggacgacgtggaaccagtgaacgacttgaatcgggactcgcagttaaacataacgaaaaatctgctatctgatatggagaagtttgcctacgtaggtgcaataaacattttggcaaatcaaatgtgcacgaatttggctacgctgtgtctttgtattgacattaaatcccacaagaaactagcacatagattacagtttacccagaaggatatggctgcttggaaaactgtggttttatcacggctatatgatcatttggggatatctcaagaagaaattgttatgattgagaagctttctctgcacaaaatccaattggaagatttgtgtaaatgtttgaaaaccactcagagcattgataatccatgggagaatgatagagaccacgaagaagacggtatagaggaaactacggaacgaatgagtccaaatgaacaaaatggctcagtacaggctagtactcccgacccagaacaatccgcaacacctgaaacaccaaaggctaaacaatcaccgttatcttcggacgttccaggaaaagtactcgatccggaaaatgtcaaaagccaagacaaattaaatatagatgtggcgtggaccattatatgtgatcttttcctaatatgcttgcaatcctccacctatgattcgaggtcaaggactttgttgataaattttgccaaagtcttgaatatgactagcttggaaatttgtgaatttgaaagacgagtaacagattccttagacatggaacaatctacagaagatcaagtatgggatgaacaagatcacatgagaaatagacggagaagcaaaagaagaaagaaaatggcatatgtcgcacttgccatggtaggtggttctttggtccttggactaagtggtggtttactagcccccgtcattggcggggggattgctgctggtttgtcaacaataggtattactggtgctacaagtttcttgaccggagtgggtggtaccactgttgttgccgtttcaagtactgctattggtgccaacatcggtgctagaggtatgtcaaaaaggatgggaagtgtgagaacttttgagttcaggccactgcataataatagaagggttaatctaatcctaacagtgtcaggctggatggttggtaacgaagatgatgttagattgccattttctacggtggaccctgttgaaggtgacctgtactcgttatattgggagcccgaaatgctaaagtctattggtcaaacggtcagtattgtagctaccgaaatttttaccacctcgcttcaacaaattttgggtgccactgttttaacagccttgatcagttctatccaatggccgatggctttatcgaaattgggttatattttagataatccgtggaatgtttctttggacagagcttggtctgcaggcaaaattcttgctgacaccctaattgcaagaaatttaggtgcccgccccattacactggttggcttctcaataggtgcgagggtcattttttcttgtttaatcgaattgtgcaagaaaaaggctctaggtttgattgaaaacgtttatctattcggtacaccagctgtcatgaaaaaggagcaactagtcatggcaagatctgtagttagtgggaggtttgtaaatggttattcggataaagattggtttttagcatatttatttagagctgctgctggtggatttagtgctgttatgggtatttctacgatagaaaacgttgaaggtatcgagaatattaattgcactgaatttgttgatggtcatttgaattatcgtaaaagcatgcctaagttattaaaaagaattggtattgctgttttaagtgaggagtttgtcgagatagaggagatgatgaacccagaagaagtgaaaagaaaaaggaaattaataaatgatgtcgatgcagcccaaaaaaaactaagtgaaagaaaaaagcataacagttgggtgccgaagtggttgaaaccgaagaaatccaaatggaaggtcatggtcgaagaagctgtcgaagaaggaagagatatgcaagacctaccagaaaatgacgtcaataacaatgaaaacgaaaatccagatgaacatgaagggatagcaaggcaaaaacgcagagatgctgctcttgtcgatcatggggcattaatgcatgagttacaacttataaaacaagcgatgcacgaagacgaaataaagaataaagcatgccttccaggagaagacaaggaagtggaatcatcaaacgacttcttgggggagtcgcattacaaaccaccgtcaacaccaaaaattaatccaccacaaagccctaataacttccaattgttaagtgctgggagaactattcttccagaggatgatgatttcgaccctcgaggaaaaaaaaaggttgaattctctttcccagatgatatctagatggcttttattctattaaaatgatctatcatagacacattcataggttaaataggacgttctccaaaatatgtaacaatactatatagaataatatatgtgttttattctgcttttaatatttccagattttaaagttttgatacaaaatatgaaattagggacttcaaaaattctaatttagcctcgaaattgagaaatgaaattagatcataaattaactctaacaaaggagaatatatatacgtacatatatatatatatatatatataagttattgtaattgagaaaaaaataaacatcatataaaacttccgttttaatgaacgggggaaaatccatgattattctcagatttgctttcaagcaaagtttttattcagttattttttttaattatctttatcttaaaatttatcagtgcgtttcatcagaatcgctcaatatagtatgctcttcatcttcttgagactttttcagtgcgtacttagccaccaatttttttagctcgtcaagttttaccggtttttctaaaacatcgtcaaagactctactggttgccgcctcctgaaaataatttgttatggccacaattggtgttgtcgaattagcaccatttgtttgctttagtagttgaacaatgtcaatagcaccaagttttggaagcttcaaggctgtcataattaagtcaaaacttacaccactagtggctctactaactagttcatcaccggcaccaacactgacgacggtacagcccaaattttctaagtctttagtaacccgatatctatgaatcggtataggctcacaaacaagaacatccatgtggtatccaatctcagaagtgctcgagctctttcggccactacgcctcctgtttcttaaagagttaactcttgatatagcctgtagtcggtcgctttcctctgccgagagatcactggaattggtccgttgcgaaaaactctttgatagaaccctctgtcttgaaaaatatgagctcacggtggtggtattagcaggtgatagtggcgacttgaatttagtcatcgtaggtgaatccgagctatttgctgttgtttgttggttatccccgattatactacccttccttgataatgttgacgagtcgatactaatacttcgttcaggagaatatgatcttgtggagaatgaatcagacctcaaaaatgttttgggaaatgtgccaaatgttgaaggagaaccggatatggtaggcttatgtattttcaacttgccaccagatgtagtgtttgaagcgttactccctggagttgacactgatccgtctgaggatgaccccattagtgacgcagaagaggttcttctgtgaaccccaggttgttcagaaaaatgttcacttttcagtctatttatagcatctttattagctttatcaagagccgataaattcctgaaattaaaagaaccaaattccgtttgtgaatcattcaatttacttgatctgcgatccctcatatgtggaggtatagccagtgacaaattcttcagattgggtgagtttttggcacttgtagtagttgtaccggtcccgttaggtgtaatatatcctgtttcttgaggtactgactctaatacagaagcaatacttaatttattaaccggtgtatgtgcaccaaagtcatgcacgctactgttggaattatttgagctcctattagtggtgttactcatcgatagtttacgggataaaatatttttatgattcaatggtggagagagattagctgcagataattcagaaacatcggtgttaatgccatgtttaccaaacaaaatattggcattatcgttttcgatatcgtctccaaaatcttggagctctgcaccccttaggtcaaaataatcagtatcttctggattgtctattgtagggacaaaagaagcttcctcatcgtaaacatgatcccaatccacattcttgaaataagggtgatctttaatttcttgaattcctttcgcacccagtcttttcgcaggatccacaaccaacaatttttctatcaaatcttttgcctctggtgttaggaattctcgctcttcttcttcatttttaaactctggccattgaatgactcctgatagaattttcttaaaaacagcatctggtgtttctgcatggaatggaggataccctaaaagtaattcgaaaaatatacaaccaactgaccaccagtcgcattgcttgttatcttcaccctttccttcaatagtttctggagcgagataatcgggagtcccaaaaaatttcttattttgcttgctatcatcaggataaaacaaagctaaatccgaaggtgctggcgaaagggaaatgttattattcgagttaatattcgtattggtagctgcgatagcatctgaagataataggtcattagaaaaggatttattctcagtgagtgatttccttctcataatattattagcgttcgaatttgtgggatttgctaaaggaggagtactagaacgagaaatatcaaggagggaaaatgataattgagattcacttcttctaagggacgctgggagatcgatgttcgaacttccgtgtgatctgtccttcccacggtaatatgaaggataaacaacagtgttcgtactgggcgttggcgtcattgagtgggaattggaagtacttgagtattctgagtgttcgtattgctgacctagtgatgacttcttgcttctattatactgcttatgatctgatgtgaagctatctggggttgataattgagaatgattactattgttgttgttcatggtaaaattatttgctgggttatcgattggtaaagtggaactgatacttagcgacgacttatgtgggacaaacttgtgacggcgaatcagaccagctcttgataaaccgaaatctgttaatttcacatgacctgcattatcaattagtagattttcaggctttaagtcatgatgaatgatcccattttgatgcatatcattcacaccgacaacgatttcggttaggtattgcttggcccattgatcgggcagataccccatcatcttgattaaagtggccaaatctccacctggtaaatattccatcactaagaaaaggttatctttattttggaaactagcaaatagtctcgcaacatagggcttatcactttgaaccatcatgattgctctctcggatttgacatttgttacttgatttttggcaatcatatctgatttccttagaacctttatagcaaaataatctcctgtgagttttttccgtgctagataaacactaccataagcacctttgctgattggtttcaagatatcgtaatcttttatgctaggcgttggagatttaacagtttggtttgtggccaataaaaggggtgataatggcatattcggtgaagttaacattgcattattgatactatctgttctggcaatattggaagggtgctgctctggggttaaaaaatccttggagaatgtgaaaggtgaagatatcggcgatttatcatgaatcagtttaaaactgtttgtctgctgcatagaatggcttgcgagattaccaaatgatggtgaaccacgccttggggtcaaggaaatacttgtcattagttttggtaatactgagtttgtggaattgttactattagtcttggtacccgtggtggtcgcctgagtagaggatgttatggtggtatctacggaaggttgaggttgaagagaatctttatctctagacagcatttcgttggtgcggtcatcattatctacatgtgagtattctatcttttgtcttggtgttatggatcttgatcttatccccagccttgacgaagaggaagaaggtctttccgagttactagtccgagagtcggtggcttcaccaataccatactgtttcatactactacccctactattagtgttattatctctatcaatagatatcgtggattcgatacttgggttcggaatgatgtcagcgtttaaataggcatcagagaataatccgtttgagtcaagtttccttcgaggtgtcggtagtttcataacggtgttgctacaactacggggcaaaggagaaggatgcctgatatcatttgcagttggtgtttcttcaatggaagaaaccgggaaaggaataggctccagatgagacttggagggtgcttcaaaggacgcacattggtcgtgttggacttgcaggggagtagaggaggaatatatgagattctcggcttctggttgttgagagtgaatttgcggcagtggggaatgaaatatggaagaagaccttaaattcattgggtgagttaggattgcatgcttatttatttcaatttgctcgcggatcagttgtaccacatagttgttgacctcgtttttaatctttaaagaataggtcattgcgttatccaacctcaacacggcatccacttttttccttgccaagtccagagtatcgtgaatcaaaagagctagtccaggatcctgatcatcattgagaaaaaatcttgattgccacgacgtgacgttttgaatgttgtggttagtccttggggaaaactgaaaatatgaattcaagctaactgtatctttttggatagggaattgatctaacaaagcattgttattattattattattattattattattgttattattaccattatcttgaggaaatgttgaaagactgtggtaaagatcaggaaccatttcactcgggttgatatctatggcgtcctgacacagctctcttaaggagtctaaaacttggttaaggaagttgttggaacgtacctgtatctgactgcccttatactctgaatctttcgtgaagtttgccaagatcgcctgttgctcaagaagattatcgtgtagtaattgtatgagcgattccgttctatgctcgcaaacgcaactttgcgaatgggtctccaaccaccaaacagggacaaagttctcacagacccggcatagttccatttttggcagaggtagattgaactcgtctattatcatttccagtcgtattctcttcaagtactgcacgaagatcttagcgccgaacccaagcgtcttggcgaactcttcgggaagttggatatcgatatcgtcgcaattatcggataactggatgaccatgtcgtcttgagcgtcttcgttggcataaaagtctgaccagtcgtttgtgcgaggcttgactatccacatcgtgtgagagggcaactgtgtgtggccatccctgattaagataccacgtgcttccaaggtcgttatcgtactttcatcgtcacagcctgcgctaccttcatagtcggctgcctttatcttgaacgttatagtgcaactggtgtcatcattcatgagcagcatgtctgtggccttttgaaagacacctttatcttgatcggatccgagaataaggtctgcaatgtacgtcggagaagagccactatcatcggcgactcctgtgatcgtgttccactgtggagagccatatcgcaccttgccgtccagttccagctccaagatcatacacggattcttctctgtggccagctgcagatatttttcataattggaggaagtcaatgagcttgggttcgaattcgatgatatcggggagagcttgtttatgccaagtccctctttcatagcctgagatccgcctgcggtgttacttctattgaacatctgtcttcctctactgggcttatctattctatcaaatgaggcaagagaaaggaaagggaaaaaagggaaaatgcttgatgagttaggaattcagtaaaagcacccaccagaacctctacagcaggccttccaggagtggttaagaggatagagaattctgtatatatatatacgtctatatctatacaaaaaacggcagacaatgcagaagttgaaaatgctgtgatacgaacaacaacttatttttacaatgaaaaacaacaccaagctgccaaaagctgtatattaaagttaaagctccctcatttttagtaaggacgctttcttttcccacaaaagggacgaggaaaaaaagaaaaacctggaaatatagtcacgtgacatgaataaacaagacctagggcaatatggaaaaagaagctaggataaaaatacatttatgagggttgtaaggcaaagtggctcagcattaagtagggctaaaaagagtcgcaaatatacatcgtaccgagtgatgaacgtggttttgaacaccttgttctcttttgttctcgctccctacattcactatatattagaagaaatttcacctcaatggacaactcgagaaatgaatacagaaatatgttttttagcgaaattttcctttcttcttgtcttcttgttttatttaaacttccaaggctttaactcagtgtcaaacataacaacctcctcctcccccacctacgacaacaaccgccactatggaaatgactgattttgaactaactagtaattcgcaatcgaacttggctatccctaccaacttcaagtcgactctgcctccaaggaaaagagccaagacaaaagaggaaaaggaacagcgaaggatcgagcgtattttgagaaacagaagagctgctcaccagagcagagagaaaaaaagactacatctgcagtatctcgagagaaaatgttctcttttggaaaatttactgaacagcgtcaaccttgaaaaactggctgaccacgaagacgcgttgacttgcagccacgacgcttttgttgcttctcttgacgagtacagggatttccagagcacgaggggcgcttcactggacaccagggccagttcgcactcgtcgtctgatacgttcacaccttcacctctgaactgtacaatggagcctgcgactttgtcgcccaagagtatgcgcgattccgcgtcggaccaagagacttcatgggagctgcagatgtttaagacggaaaatgtaccagagtcgacgacgctacctgccgtagacaacaacaatttgtttgatgcggtggcctcgccgttggcagacccactctgcgacgatatagcgggaaacagtctaccctttgacaattcaattgatcttgacaattggcgtaatccagccgtgattacgatgaccaggaaactacagtgaacaagaacactagccccagcttttgctttctgctttttttctttttttttttttagttcgtggttctctgatgggggaggagccggttaaagtaccttcaaaagcagaatgcagggttattggaagctttctttttttcttttatgctagtttttcctgaacaaatagagccattcttttcttattactaagaaatggacggcttgcttgtactgtccgaagcgcagtcaggtttgaattcatttgaattgaatgatttcttcatcacttcatgaagacaatcgcaagagggtataattttttttttctcgttattatcgctgttggtgggttttttcttttcatatatttctttttcgcttagtggtttctactgttctgtctccggttagtgtgtgctacttcaaccgaagaagaagaggcttttcaagaatgcaaacgtgaggttggcgcgccctcctacaattatttgtggcgactgggcagcgacactgaacatagctcttgaacaagacccttttttggctgcaaggagcaagactggctggggttccacctcaaagagccacgctctgctttttttctatctgtttgtgtcatatctatctgtctatttatctatatatatatttttttatataaaactataaagaattcttgatgtatgcccttaggttgggcagcttttcaaccttagacttgatgctaacgccgctctgttccttctcccgtgctcccgcaagcgaacatctccccctaactccgggccaatgagtgataactatatcaaataccttcgaaaggaccttagtcatcatatcactctcactctcacggctctctgtagtcctcctcgaggagtggccaagaatgttctgttccgcagtctttatataatcgcactggttgaagacgaaagctcatataattctttttccatagcctaaatacaccaacgatgactaaatctgtagatacgctgctgatcccaggccccattatcctaagcggagcagtccagaaggccctggacgttccctctttgggccacacctctcctgagttcgtctctatttttcaaagggtgctaaagaacacaagagctgtcttcaaatccgctgctgcctcgaagtctcagccttttgtgcttgccggctctggtacgttggggtgggacatatttgcctcgaactttattctttcgaaggcccccaacaagaacgtgctggtcgtatccactgggacattttctgacaggtttgctgactgtctgcgtagctacggtgcgcaagtagatgttgttaggcccctcaagataggcgaatcagttcccttagaactgattactgaaaagttgtcgcaaaatagctatggggctgtcacggttacgcacgttgacacttcaacggcagtgctgtccgatctgaaagccatttcgcaagcgattaagcagacttcgccggaaacgttcttcgtagtcgatgctgtatgctcgattggatgcgaagagtttgaatttgatgaatggggggtggatttcgccttgactgcttcgcaaaaggctattggcgctccagcgggtctttctatctcgctatgcagtagcagattcatggattatgcactcaacgacagcaaaaatggtcatgtacatgggtatttttcctcgttgagaagatggacaccaataatggaaaattatgaggctggtaaaggagcttattttgcaaccccacccgtacaactaattaatagccttgatgtagccttgaaagaaattctcgaagaggggttgcataagagatgggatttgcaccgtgaaatgagtgattggtttaaagacagtttggttaatggcttgcaattgacatccgtcagtaggtatccttctaacatgtctgcgcacgggttgacagccgtatacgtagcagatcctcctgatgtcattgcttttttaaagtcacacggtgtagtcattgccggaggtattcacaaggacatcggacccaagtatatccgtattggacatatgggtgtgaccgcttgcaacaagaatttaccgtacatgaagaactgcttcgacttaataaaactagctcttcagaggaaaaagtgattaccctcgtacttttcatttcatatatatatatatatatatatatgtacctatatattcttcttattatggcttttctaattcttgcaagattctttgacagctccatctttcgtttggtgaaaatgaaaccatccccaggatacaattaatgaacttctgcttgactttgacatccgcaatctcgtccagtcgaggcatattcctctcaacaatgctaatctgtacatctttctcctggtccagtacatacttgccatcgccatctgcaccaaacataccaacaaatgcatcaaccgagccgtgttgcgcaacctcttcccatttctgaatggacggtatgcccaacttttcgaatattgagcaaatcagtctgaaatcgcttccatctgagttcatgtcgtcgctgccgtcatcaatcatggccggaacgtgccccatacggcttgtttctctctggaaccactgagaaataattatcaacaacgaccacacgtccacgccaccatcatagcattttactccaaaaagcacttctggggccttgtaaattcctgtgcttatatccgtcaccttgctatccatgggttccgcacttgtttgtgagttatttgccatgtcataagagatgccaaaatcaattatgtacaactttggggatacggtgctggtattgtttgttagcatgatattttgcggtttgatgtcgcggtgaatgatcttgttctcatgtaagaatgcaatcccttcaaccatttgccggaaaaaggacaaagaataccgattgacgtccaattgattagtatatttctgaacgggggggtccgcaacaattgggatactgggatttagcaaatcgtaatagggatttttttttcttctatctcttttatagtgcatttgcatgaactcataaaggttcatctcttcaaagggaaacaacaacaataggtcattattatcggtagccttagactctagaagaggtaagatgtgcttacatttgttgcccagtttgtttaatatcgatacttcgaatttggcgttatgtggcgggatatcgaaatctagtgctagacatttaatggcatatgtatccgacctataaatcctagcagttctagtagatttgaccaactgacagtgtgtaatgtctatactatccagtttcattaagatgggcgtgaattttgttgcctctcttcttcatctggcctctttgcttctatgagacttctgtcgttttcctttttttaggatcacaaactacttctataacttaaatagtcaaatcacattttccactaagatacatattttctatacagggggtctttgcagttatatatactcagttatataccaatctctttgtcaggaatttgattatcacgtttcaaccattctagtgctaatggatgcaaactattcactttactaataacaaccttattgttgtcattttcaaaggccacttgtccattaactttagcattgaccacttcagagaactctacgtctttctgataatctaaattatccacaatcttacctgatttcatatggtatacttggttaggccatttggccaagccgtcaaaaatatgtgtagcgtagaccactgagcatcttctggtttcggtctcccactttaaaaactccagaagtcttgctctggcaataacatcgagatccacagtgacctcatcaagtagtaaaactctccaaggtttcaagagccccatggctaactgaactcttctcttttgtccatcacttaacctgtgcattctccaacgtacatcgatgtccaggattctaaccaatctttcacctctttccctaaaatgatcgaatccaatactttttaatagttccaagacgccgatatccctattaatgatactcatatggcaccattccgtacctagataagtggtcgtttggtagttcgtcgaatcttcaacactttcatcatcgtccacttgattcatagataatggactgaatggatcaagaccattgaccaggatttttccatcaaggcaaagatgcttaccgcttagtaatttcaaaagggtggatttaccagcaccattggcacccacaactaaagatcttgtattccatgggatttgaagattgatatcaacaactgacggatcggagctttctttgaatttgtacgttaggttacgcacctcaatagcaaattgggaaaccatcttgagagttatctaatatcttgatatcttatgcaggagtactggttttctccatactaaaaatctctctttcagaattttcgttttttcttatttgagtcatcctcgaagaaatttccgcagcgaattttaaagaagcactttataataataccttacatatgagtttgtttctatgtcatgggtatataaggtatattgtatgctatctagttggatgccccagtttcaaaatgtccctaatcggatccacccagatgtgactaacgtggtgcaaatttatatttatatgtgataagtctttcaactttgtggagatcatgtaacgtagattgagtactaaactcaacgaccttgtagtccgtaattggtacaggatagctacaatcccgataagtaaagaaattttgctccacctgttatatttggagggtaaaaaatggccaagtctttggaccaacgcccttgtcttggatctggcggcgacaccatgatacttttcttccttgtaatgctcgttcatctttgtttgttcgctcaaatagaagataatggtgctcatatcgaagcatcctggctttccacatgctgtattgagtaatgcactatatttattaagactcacccgtttcaaagccttcttgctggcagtagtcgcatcttttctagttatttgcaagacttcttcccaaagcgcctcatcatacagttttttctgtaaaactgtttgtatagcaccatggcgcaggtcaaaatcgttctcgaagaaatcagaattagcttctatttgcttcgaaatttcagacgcattttgcaatagcaggttcttgtatatgatcaaaggtaaacgcatagattgcatcgatattgtcatgtcaaatatctggaaaagaattttatgaagattgttgtcaccgctatctataggtttcaaattatgtgcaaagattgtcaatattgacccaatagcgaaaaggggctcattttcgtcaaatttgaatagattatagaatttcatgtttgattcctttatcaatgaagagattactctcaattgctcaaatgaaaaatctagtgagttcatcatgaaatccctcagatataatagggtaaatgcttcgatgcaataaaacagcctttccatatcaatttcttcttgcaatgagagattttctagttccagtccgttctcttttgtgacattccaactaaaacacatgatgaaaacagacacaatatcatgataaccttggtaatagttcaacgttgggtactttctcaatacccgagtaattaactccaccagtagttttctcaattgcagtttcaagtttttgtcgacaattccaccaaaagacctttctgcatccaatatcacctgaccttcatctttatgtttttccactggtgtaatgtactctgttgcatcatcaataagcaactgggacgccaataattcataccaacaatcttttcttaatgagttgtttacaaaccccagaggccctaaacctatgtacctcaaagctcggacatcttttttctctaataactttgatataacttttcctttttgttcttctgcctttccactgtcacaacgagaaagtgattccagatatgcgttataacctccccttgtcaacgcgtctttgtcgtggctactctgattagtatgaaataatgaccttaatggcatcgtattttgttaattggcttgttctatgtcatttgctaaattttctctttatttctttactttgccaattcaagataatcttcccttcccagagagaaaaaaggaaaaatttagctatgaaacctcaataagctttttaatacaccaaagattcaagataagagcatagaacgaactgtagaatagtccggatatgttatccaatgcctgccaaaatgcattgtcacacgctgtagtgctcgaataggtgttgcaatccgtcaatatacgtcttgctctgtgggtaaatgtctcgtgcattaagacaggctagtataaacgagaagaagtatcctgctttgcaatgaaacaatagtatccgctaagaatttaagcaggccaacgtccatactgcttaggacctgtgcctggcaagtcgcagattgaagttttttcaaccatgtaaatttcctaattgggtaagtacatgatgaaacacatatgaagaaaaaagctttcctacatattcaagatttttttctgtgggtggaatactatttaaggagtgctattagtatcttatttgacttcaaagcaatacgataccttttcttttcacctgctctggctataattataattggttacttaaaaatgcaccgttaagaaccatatccaagaatcaaaaatgtctgatgcggctccttcattgagcaatctattttatgatccaacgtataatcctggtcaaagcaccattaactacacttccatatatgggaatggatctaccatcactttcgatgagttgcaaggtttagttaacagtactgttactcaggccattatgtttggtgtcagatgtggtgcagctgctttgactttgattgtcatgtggatgacatcgagaagcagaaaaacgccgattttcattatcaaccaagtttcattgtttttaatcattttgcattctgcactctattttaaatatttactgtctaattactcttcagtgacttacgctctcaccggatttcctcagttcatcagtagaggtgacgttcatgtttatggtgctacaaatataattcaagtccttcttgtggcttctattgagacttcactggtgtttcagataaaagttattttcacaggcgacaacttcaaaaggataggtttgatgctgacgtcgatatctttcactttagggattgctacagttaccatgtattttgtaagcgctgttaaaggtatgattgtgacttataatgatgttagtgccacccaagataaatacttcaatgcatccacaattttacttgcatcctcaataaactttatgtcatttgtcctggtagttaaattgattttagctattagatcaagaagattccttggtctcaagcagttcgatagtttccatattttactcataatgtcatgtcaatctttgttggttccatcgataatattcatcctcgcatacagtttgaaaccaaaccagggaacagatgtcttgactactgttgcaacattacttgctgtattgtctttaccattatcatcaatgtgggccacggctgctaataatgcatccaaaacaaacacaattacttcagactttacaacatccacagataggttttatccaggcacgctgtctagctttcaaactgatagtatcaacaacgatgctaaaagcagtctcagaagtagattatatgacctatatcctagaaggaaggaaacaacatcggataaacattcggaaagaacttttgtttctgagactgcagatgatatagagaaaaatcagttttatcagttgcccacacctacgagttcaaaaaatactaggataggaccgtttgctgatgcaagttacaaagagggagaagttgaacccgtcgacatgtacactcccgatacggcagctgatgaggaagccagaaagttctggactgaagataataataatttatgatcaaaatttacggctttgaaaaagtaatttcgtgaccttcggtataaggttactactagattcaggtgctcatcagatgcaccacattctctataaaaaaaaatggtatctttcttatttgataatatttaaactcctttacataataaacatctcgtaagtagtggtagaaaccacctttgcttttacgagttcaagcttttttcttgccatgatctagaactctcaggcaatatatacagttaatctttttttactgggttgtagttctaatgtattgtttcgaaaaatagcaaccaggcacatattatgttcaccaagtggtgtatccagtacagatttcttattccataaatgaaactgaaaacggttaagtacacaaataaaatgatggtaactttaccatcccacgtgtctaaaggtacgctgtttggcattttgaaaatagaattatttccaaccaaaaaaataattggtgccactgctagtatattgtgatgggatctaaatgaagtttcccatttgatggcaacattatgcaggaaaacaataatgatagggatgttaatggcactaacaaataataaaagcagaagcaacgtcatattataatttagtaagttcaatttctgctcgttgtttgatagtttcaacagcgctactctaatgcaggtagcaatttggattactaatgagataacaaacgccatctggtatggtatgtgaaaaaataccaacagtaataaaagcacagatgccattaatcttcccttaccatacgctttatgttcaatagtatcaaaagcctctttatcttcagtgtttttctttgataacttccgttgaaggaatattactaaaatttccaaggatccaaaaatcttagaaactagtgctagtaatccaactgtcataaccccaaagagaattccaatagttgacataaaccaatctctgatccccaaataataaaaatttgcatgcatgtttctctcggatagcagaaatggataatttaaaccgacaggatccaataaataaagtattcgttgtaccaacttattattaaccacaggcgaagctaagaacagcgtaaaaaacattaatattccgtgctttcttaaaatatatcccaaagtgctatcaaaggaaggaaactcagatgtcttgttgtaccagtagaactggtatgacagtacgagtgctataaacgcgactggaaaagatgctagtgctaatctgtacctgataaacagcattttcaaagttaaagaccaattaatagtcattttagcttctaaggacattccgggtggaataaaaaaacttaattgtagcgatctcggttcgctttcatttaatgggataaacggtgctacattatgcatatttatatcgagacttttgtttataatatttagatgccatttagactcgaaaggttcgtaaacccattgccttatgaaaggctgaaacaatgtctcttcggaagcaataccttcgttgcttgcctcaatcttggtttctaatttgtacgataataaagaatcccacaaattactgaaacttataacctgctcgatgtctttgccatccaagtgtagttgttctccaaagagcaatatttgagaaggtgtagtattgactatttgtacattggagacgttgcgcagtaatgccaaaagaaacccctgattgtcctccatgccttcttgttctgaaaattcaccgtaagtgggtttgcttatcatcaagtagtcgtacttctgtagtatattcttgccaacactaacggctttaaacggattttttgcttctccaaaagaagaatcagctgcgaactgagtatcttttgaagacctgggcactgttagaatactatcaacagctgttatacagcttagattcaccctggactctgtacagaaatagatcataggcatatcgagactagttaataatgtgaaatgcaggtgttcagtggaggagatgttactcggaatatttatttttgtataattgttgtgccacttttccaggttaaacatttcaaaatctaggacatcgttcatttccaaagtagcgtaatcagaaaagaagttgtcactaaattcttgtaagttttcttgaggataatttaacttactattcatccatgagtagtcttcaaaccctgaaagcaatagttttctagcgatttgcaatctctgattcaatggcttaactttttcaggtttggaggcatctatactttccaataaaaggcgcgctagtacctctcttaattgcttgcaccaaacaatggctaaatgatcaattggagtccaaacatctggaatagtagttgtgaagctggtgaacccattttctaagctaaccaaatcttctacagatgcataatctgcaggtaaagtagtatccaatataccgcctgtaatggaaaccaatgaaatgttcttagagaaaaaagaatcgttttgggataactgctttctccaatattcgtttgtatttttgtaaagctttaaaatgtcaccatcaaaggttactggtgaagcagcatgaggtgatgataaggtcaatatggtgcttatacttcccggtacgtggttcttcaaagttagcatgaccctggatacaataccgcccatggaatgtcccacgataataactgactgcggttttggatgtgggtaatcaggggtcctttcgtaaagagacaagatgtacttaatggcatcatttaggtattcagcttgatcaagcattgtttcaccatgaaacgcagtgaaatcttcattgaaatctgccgtaaagaagtccaaatttcgcacattttcgttacgcagagtcgccctggtattggaatcaaaatatatattggagcaagcggaagcaatcgatctgcattgcctaaaagaacctgcatttccgggtataaaaagtacagggataccatcaagttgtaactcatcaccatttaaaggttctcggtctacgctttgttctcgatacaagtaaagatgatacttgtgtgccagtggtgtatacctctcgtcaaatccatcgatccttgcgtaagatggaaacatatagatagattcacactgaggagcatctgcaccattaaaaggtttcagtagcgatatcaataaaagcgagcaaatgcttaaaatgccaagaatagagaaaaggcgatatgtgtaaggtttttttgctatcttatcattgttcatatatttgggggaagctttatcctggtcttcacgcgtagcgagtactctcgagtattgaccagatgagttaactttattaattatgggccgcgttataacactaactaatctcctgatacccataacgaaatgaagatttttgtatgatggtaagcctaagatataggccaatgctttaaagtagagggagtatttcgagtgtgaatttactatcagatggaactgcaaggaatgtgttgagactcatttttactttttcttgttatgacttggttggtatatttagacctttttcaaaattcgcgccatacaggaaaaaaaaatggataataagaagaaatgcatttatttgagggtacctagtgagttatgcaattgtctatataagagtatgaatctaacttaaatacatcaagcatttgggatgaaatcatgcgaaaaatcaaaaggtcacaaccgtgtgaaatggaaattaaaaaaaacgttaaaaatatgtagtcttgtgaaggtgataatattacagccggatgatacttgctatttttcttttgaaatttattgtagttatctttttttgttttttgttttttttcattattattgcgttatcggtgttcatttcggtgatttgaatcttcagtaatgttgcctcgactttcgtagtaaactttgaatgtcaggtttgttaaatgccaatgcgtagaaagatgttcgagaggtacaaagttgtgctgctcatgatgaatttttctgggttatagaagagttctgtttcgcttctgaattgattaacgaatcatttaatttttttagggagttcgaagaatttgaattattgttctgtgatttctgcttttgttgttgtgcttgctgctgttgctgctgctgctgttgttgttgctgttgtaaatgttgtatatgcttttgtttcagtctggtgatatagtccctacgatactttatggtggcttcccttaattgttcgtaggacttcgtacccaacattgttccgaatctaatcacctgagtatcatttgaaatctggttaagtcttgccggttcatctgaaaacttgatcccatattcattttgtggagaatcatacttccacttgtcgtaaagtctgacaaattcgtcgtatttggaatcgtaaacattaatcgagtcagtatcgttactaccttctcttgaatattgttctttttcgattgaatcgaaatctacaaaatccattaaagaacatgcagacttggtcgacgatgttgtaaaatttggcatacgatcaacatacttaatattagatctaccaactctcttcctgaattttattggatactctctcgaatgaatttccaaattttcttggaatgggtcgtacagttcagtttttttgattcttttggtatccaagttgtaattatctttgtttctcgaacggccatttgaatcatatattctgatgtcatcagatatccccttcaagtattctggtaaatgtgaagaataaaaagatctatctatctgaaacttggatgacgcgatagatgcaaagggaacattactagtcgaaaaatttttaggcaacgacatgtcaaatacaggattaaagggatcgtccgttaagttgaaaaagacatctgcgtcttcaattttccgtttctccatcttttcctgaacgaactttcttgcatttttttctttgctgttcaatagagcatccacgtcttccaatacaatgtcaggaattttggaagatggtagtttgacataaacatgagacgtaattggctgtgatgttgaagaagaggatgcattcgcgagttgctttccgttttcagtcttaagggcattttgctgttgttgttgttgttgctgtaacagttgctgctgttgctgcttggtgagcctagaagatttgtcttcaagttggttattccttttattgttctttgccttcgctgccgctgctgcagcagctgctctcttaagttcagctttccttagttcagcttccctttgttcgaccgtaacaatcgtggggcgttttctcttgtggttaatcaagtcatcgtcttctccactaatgttcaaagatcttttcaaattcttaatttttaccctttgatcgaatatttttaattcatcattaatccaatttagggaaacgttctcacgtttagcaacaagcagggccaagtccttcgcgtttttcaattcttgatgcaacgcccttaaacgctgactgtttaagatatctatacgtcttgttttccgcggatgtctcacttctcttcttctgaaacagacgtagggatcaatctcttctttttcacccggcctttcaaatttcagctgcggaaaaatttcgtacccgttaacttcaatttttctttctctccaataatcataaattttagagccgaacttctctatcagctgaattaaaggtctcgtattcatttgagatacggggtcgaattgtgtgataaaatgtgttttatgagaatttatttcatgattcagctggtttcttagattgaaatcagccatatctgattttattaatgtgggcttcaattcttcaaaagaaagtatactttccggatccatactcaagaatggttgacgctcgtgaatagcatgttcaaaactggaacaaagtatttcaaattcgtcttcagttaaaatgtctgatgaacctttgttgacttgttcatttaaaaaggtctcatctctttcatccatattgtagttggtaccacagcaatcctccacagtggcagaaaatttgatgtagctggtggtctcctggaaactgcccgtataaaacttatcatattcattccaagtcatagaagcatccggggtcggaatatagtctttgtgctttgtatgaccagaacccatttgtaatattcgatgcaaatggacctccttttcttcatttttttctacaccagtttcgatctcaaccacctctctctgttgcaattcatctttatccaggtgtttcagatcgttaggcagatatatcttaagatgttgcttcacagatatttttcgatgtctaaatcgactattactgctaccagcactggctccagcacctgaatcgccttttgagaatgaatctagaccgtcatcgtgcgcactcctagatccagaccgcctagtgcttctaccagatttatgcgaaccgtcattgatctctatagcgtttgaaggtgtcggcatcgttattatcgttatttgctaatgttattacaatgtttttataagcacgtgactataatgttaccctatcgtgtgcaatttttatttatgttgacctgaagtccgcagttgccgtacaatgtgagaatatggacaaaaggaaggcgagggtggcaaaaagaggagtcaaaaatagatagcgtttattttattatagcagctcagaggaacgcgatgtggtgtaataatattgcgagtgtctaatgaccaccagaatacgagcacagttttggctgatttttgcaaacttttttgcttttgtgtagtaacctctcacaggtattgcttgtatgctataccatgtgatatgtaatagtacaattttgtggtcggatcgtgcttttgccacccgcggccgacggagaaaatttttttcctctatccctttgtttctcgcttactcctgcggtatggggtgctaactatggtgagcgagtatgggaagaagtagcgatatacgggtaaccctaatgtttgggtgttttgaaatttatccttggaggataggcgatgagctgctcttaaaggttttaacagagagtgttgtatgaatattctgtagaattttatagtaaacaggtatcctcagactgtaatagccatggatttgttagcggccagcgtagaaagtacgttgaaaaatctgcaagataagagaaactttctttcggaacaaagagagcactatatagatatcagaagccgactggttagatttatcaatgacaatgatgatggcgaagaagaaggcgaaggccaagggatggtgtttggtgatatcataatttctacgagtaagatatatctaagtctaggctatgagtattacgttgaaaagaccaaagaggaggccatcacgtttgttgatgataaattaaaactaatggaggacgccattgagcaatttaacctgaagatcgaagaggctaaaaagaccttagacaacttgaatcacatggaggacggaaatggaattgaagaagacgaagcgaacaacgacgaagattttctgccctctatggagattagagaagaactagatgacgagggaaatgtcataagtagttccgttacccctacaacaaagcaaccatcacaatcgaattccaaaaaagaacagacacctgcagtcggtccaaaggagaaaggattagcaaaggagaagaaatcaaagtcattcgaagaaaacttgaaaggaaagttattgaaaaggaacgatgaagtaaagaaaaaagtgcagccatctaaagtagatacagaaaacgtgtatacatttgccgacttggtccaacagatggaccaacaagatgaattggaggacggctatattgaaactgatgaaataaattatgattatgatgcgttcgaaaactccaatttcaaagtcaatgataactatgaagaggatgacgaggacgaagatgaagaagagtatctaaatcattctattatacctggctttgaagcgcagtcctcatttttacaacaaattcaacgcctacgcgcacaaaagcaatcccaagatcatgagagggaagaaggtgacgttaataaatcattaaaacctattttgaaaaagtcttcttttgctgagaattcagacaaaaagcagaaaaagaaacaagtcgggtttgcatcttctctagaaattcacgaagtcgaaaacttgaaagaagagaacaagaggcagatgcaatcctttgcggtgcccatgtatgaaacccaggaaagcacaggtatcgctaataaaatgacatcggatgagtttgatggtgatttatttgctaagatgttgggtgtccaagaggccgatgaagtgcatgaaaaatataaagaggaactgataaatcaggagagacttgaaggggaagcaagcaggtcgaatagaagaactagggtgtccagattccggaaggatagagcttctaaaaaagaaaatacgttatcaactttcaaacaggaaacgacaaggtcagtggagaacgaggtagtggaaaaagagcctgttgtgggggatattatagaaaaagaacctgttgtgggggatgttatagaaaaagagcctgctgttaccgatatagtggaaaaagagcctgctgtcaacgatatagtggaaagggagcctgttgtgggggatattgtagaaaaagaacctgctgtcaacgatatagtggaaagggagcctgttgtgggggatattatagaaaaagagcctgctgtcaacgatatagtggaaaaggagcctgctgtcaccgatatagtggaagaagaacctgttatcaacgatatagtggaaaaagaacctgttatcaacgatatagtggaaaaagagcctgttgtgggggatattatagaaaaagagcctgctgtcaacgatatagtggaaaaagaaccggaaatcaacagcaagagcgagttggagactccttttaaaaagaaaaagctaaaatcactgcaaaaaccaagatcatcgaaatcaatgaaaaaaaaatttgatcccaaaattctcgaaaatataagtgatgacgataatgatgatgacgatggtaataagaaacttttgtccaacaaaagtaaaaataacactgatgagcaagataaatttccttcaaaaatccaagaggtgtctaggtcgatggctaagacgggcgccacagtagggagtgagccggttagaattacaaatgtcgattatcacgccctaggtggaaacttggatgatatggtcaaggcatattcattggggttatatgacgacgatttagaggaagatccaggaaccatagtggaaaagctcgaggatttcaaagaatacaataagcaggtggagttgttgcgtgacgaaattcgagactttcaactagaaaaccagccagtgacgatggaggaggaggaaaatgatggcaatgttatgaatgatatcattgagcatgaatttcctgaaagttacacaaatgacgaggacgaagtagcactacatccggaccggctacaggaagaggttgctatagagtacagacggttgaaggaagctacggcgtcgaaatggcaatcatcatcacccgccgcacatactgaaggcgaattggagcctattgataagttcgggaacccggtcaagacaagtcgtttccgctctcaacggctccatatggacagtaaaccataacccatatggagacagaaagtaaatcagaatctatattaacatatacgtatatatttgttttgtgtacaataactactacaaaattggggacagacgatataaaactagaggaactgctgagcttattcgtacaagtcttcgtccaatctagcagcaggattggtttcgataaagtccaaagagactttatgacctaacagttctctgatgttctgaaccttatatttgatcatggtaggtctttccaaggataacccccaaccaaggactcttagatcctttggtagacccatggactcgagcatttctggtctgaacataccagagttaccgatttcgacccatttttgcaaaccttcgtgccaagaaaagatttccattgatggctcggtgtaaggattgtaggtaggcttgaatctcaaaccggtgacacccattctttcgaaaaactcttccatgaacttgatcaagtcacccagagtaatgttgtagtcggcaagaacaccttccacctggtggaattcggccaaatgggtggcgtcaactgcttcgttacggaaaacacggtcgatagaaaacaatctggtgggctttggatctttggccaaatcgtgcagcattctggcagagatggctgtggagtgagttctcaagaccaatttttgacattcttctggcttccagttgtaacgataaccgatggacccgaatctcccctgttcgtgaacggctttgatattgtccatgtatgtcttgtcatcgggcaagtcagcggttagcgggtccttgatgtagaaagtgtcttgcaggtcacgagcaggatgctgttgtgggacgtaaagggcatcgaagttccagaaacctgtctcgacgtattggttcgagggcatctctgtgaatcccatggaaaagaaaatttgtctaaattcctctctgactttgtttaaggggtgaagagcacctgaagatatttgcacaccttgagaattgaaattgtaaggcttgaacttcaagtccttgtatgcattggtggagaccatgtcggaggtaagatcggtttccaatttggtgaggtcggtcgagaactctggccctttggtaacgttgaaatctgtgattttaccttgagcaattaactttcttttcttcaagtcgttcaaaatcttggcgtcaatgctatccagatgcgagttgttcttgatttgcgctagaatagattgcgtttcatcagtaagctcatttaaatcggtattttgcaattttgcggagagttcaagctcgtttgaggcgtttttggcgatccagccgttcttgaaagctctagcctgaccgaccttaccaacttgaggacccagtttggacatcacatctttgatttgaagttgacccaactcttggatgagcttgactagtttaatttcgtacgaaccttcattcaaaatttgagcgccttctttggtcaagtcatacgtaaccgtgtcgaccttggaaaactctaacttgttgtgggctttcaaagagttcaaagcggaaagaacatcttgagagccgtgctgagggaaagttgccagtgtggacttgatctcatccaattcatctagtttctttagaatttctaattggaagtcagacatctttacgttagggggtgagagagggaggggggtgcctttaatgtatatatacgtaagatatatatatatatgtatatatatggaaatgtattcacaactttacatgtgcattaaccacaagtactgtgtacgttcaagattacagcaatgcgttttattaatttttcaagcatttttcacgtagagaggaacaaagtttactgaaaagaaaagaggtagagaaaaacagaaaaaaaaatttttctgtttttcctgcctcttttctttgtttgattcaatatggtcgaccgggtaaacccctgataaaacgataccaaagccgggtcacctaacttatggccaaatgcgaccggtcccgctttccgattttagccgccgaagacgtacttggcgccataatcaaaacctagcttgcccaatacttctgagttctacgtggtgcaaaaattttttttttttnnnnnnnnnnnnnnnnnnnnnnnnnnnnnnnnnnnnnnnnnnnnnnnnnatgcatccatcagtattacggtgtcctcacacaaccctgtctctgcacaacgtaatacctccttttcccgtctgctagctctcatatcgcggtaatccaacctcaaccagcaacccggatcttctatgcgcaatccggtgtgtgggtgcatgactgattggtccggccgataacaggtgtgcttgcacccagtgcccaacgtcaacaaagcaggaacaacgggctgataagggagaagataagataagataacaaatcattgcgtccgaccacaggccgacacatagcagaacgatgtgaagcagcgcagcatagtgttagtgccggtgcagctaccgctggtattaacagccaccacaatacagagcaacaataataacagcactatgagtcgcacacttgcggtgcccggcccagccacatatatataggtgtgtgccactcccggccccggtattagcatgcacgttttctttcctttgcttttccgcccttcccctgttctgttcatcgcatgtgcatatatatatatagatatatatatacattgtacacggtgcacggtagtgaacataactatgagcacgaacagagtcccgaacctcgacccggacttgaatttaaacaaagaaatctgggacctgtactcgagcgcccagaaaatattgcccgattctaaccgtattttgaacctttcttggcgtttgcataaccgcacgtctttccatcgaattaaccgcataatgcaacattctaactctattatggacttctccgcctcgccctttgccagcggcgtgaacgccgctggcccaggcaacaacgacctcgatgacaccgatactgataaccagcaattcttcctttcagacatgaacctcaacggatcttctgtttttgaaaatgtgtttgacgacgatgacgatgatgatgacgtggagacgcactccattgtgcactcagacctgctcaacgacatggacagcgcttcccagcgtgcttcacataatgcttctggtttccctaattttctggacacttcctgctcgtcctccttcgatgaccactttattttcaccaataacttaccatttttaaataataatagcattaataataatcatagtcataatagtagtcataataataacagtcccagcatcgccaataatacaaacgcaaacacaagtgcaagtgcaagtacaaacaccaatagtccgttactgagaagaaacccctccccatctatagtgaagcctggctcgcgaagaaattcctccgtgaggaagaaaaaacctgctttaaagaagatcaagtcttccacttctgtgcaatcttcggctactccgccttcgaacacctcatccaatccggatataaaatgctccaactgcacaacctccaccactccgctgtggaggaaggaccccaagggtcttcccctgtgcaatgcttgcggcctcttcctcaagctccacggtgtcacaaggcctctgtcgttgaagactgacatcattaagaagagacagaggtcgtctaccaagataaacaacaatataacgccccctccatcgtcgtctctcaatccgggagcagcagggaaaaagaaaaactatacagcaagtgtggcggcgtccaagaggaagaactcactgaacattgtcgcacctttgaagtctcaggacatacccattccgaagattgcctcaccttccatcccacaacacctccgctctaacactcgccaccacctttcgagttccgtacccatcgaggcggaaacgttctccagctttcagcctgatatgaaattgactatgaacatgaaccttcacaacgcctcaacctcctccttcaacaacgaagctttctggaagcctttggactccgcaatagatcatcattctggagacacaaatccaaactcaaacatgaacaccactccaaatggcaatctgagcctggattgtttgaatctgaatttatagatcccccaaaaaaaaaaaagtactcgcttctttccatgtccgcttcatatatatatatatacacatactaatcaaactctatgtatacatagaataaaaagaagaacactatatttatttcataaaaaaaaaagaaatagcaaaaaaagtgcaacatttatcaaaagctcagtgtgcgttatgcttccatgtgacccaacatctattgcggcggtgacagaatagttgaaagtcgcagggctcacacacaggaatggccctcacaagttgaaaagagaactaaaccagttatcctaggcaattactttatttgagtcttatatgacgtcactagaagctcagtaagagcaaccgagacctgaacatccttttttttttttgcttctttatttggcagcatttttcaaaaataataaaatggaagccgcgagtacgaacaatgatgtgttctgggaatacctcgtcaaaacaagacaatggtaaggattttctttcatcaggcagaaagatctggatctgaatggcatcattttgtgatgtgtaaaagcgggaccttgttatttcgactttttgcatcatgttgatgcaatttgctacttttccgacggtgcgctccaacggatgggtatttccttaataacaaggcatttctctggaagttggcttactgtttgaaatcacagccggtcacaaaataaagtaaaaaaactatctctctccacaagaagtaattacaggttgtatactacgtgtgatcgtatttctttatgaacactaaggagtttcccgctgtgtaccgcaatatccacacaaaaggaaggaagaaacttctgtggcttgacagataaataactgcagtagtcggtgcgtactaattgtttggtcgtgtctgaaaaatcttgaattttcagaaaagaataagccccaaatgtcagtgatggtagtagcagtactcccctacgattttagatactttagagagcccaccttcagaatcggaaggaggataattttgtaaagcccttctgttttttctcttgcataacttatatttccacatcaaaaagtagtgtgctaagaaaaaggagacgagaaaaaggattacggcactctctgcatctagacatataccaaaagttgggtttgctcacgaaaataccataattgtggtgtcaaaaaaatcctgcctcataataccactgcagcaattgtggatgactaaaaaataacttgcattccacgatgttattttactttataaagcacctgcaatttttttttttgtattaactcatcgagtatgtctgatgtgtaaactgaaccaggcttaatatcgtttctaattcttgttgtgagaaaactttcctgcctaatgtatttcgtcagggcgaaccttcggataggcaccgaactccgagattcttgctccaatttaagaaataagctttttccgtcccaatacaatagaacattattaaagttaataataaaaatggcacggcaccagttggaagttaaatcccaacatttgctgcaagaatagaaaagaagtcataacaaatttgcatattacttacggcttcaaaaaagcaccgaaactaatcgagaaagcttataatatcggtatacatttgaatgtattttaactatttctatatacaaaaaaaaaaaaaattgtatatttttcgttattctctaattcgtatcacattttatccctaagggaatctatctctaatttgcaatagtgtagataccgtctgcggatagagcgctagagatagctggctttaatctgctagagtaccatggaacaccagtgataactctnnnnnnnnnnnnnnnnnngtgtagtggttgctgcagcggaggcaccagcggcaatggcggcgacaccagcggcgattgaagttaatttgaccattgtatttgttgttttttgggttgttgcttagtggagatataagcttaactggaaggaaaagaacagagaaatgtctcaaacaaagctgatcaaaccgctgtatttatataaattttttgagcaattacatcccaaacaggctgttactggtcactcattttgcactcatatctcacatattctaattcctggccacttagccattattactatggggatgtattttccttgaacgatgctgcacttcgtataagaaacacgcttcatattccccatatcttcgtatgtttagagcgcaagaatgttccttacagtaaaggtgcctttcgacctgcagacacaatgttagccaagtaatagaagcaaagccaatattgtcttggcctcgttcaattgcctaacccttggcactaaacggttgctaggagaaaaaacacggaccttttcccaaattagaaacactaaaaaatgttaatatggtactagtcgtcgtaccctgctgaaatcataaaaaccttacgccatctgtgggactcgtcatagggtttagtgtatattgaatgttggaaaatctctcgttctgatatgcccaacaaaccaacaatgtacaatgtgaggtttctacaaatcaacaactatggtttcccctaattcacttggattgattggttctagtgaaaactttacctgttacaaagttttgaatcattttaattagatatcgtgtaccgaacagtatctgattcgtataaaaaaaggaatattgaaggtcagttatcctaatgaaaaaaaaattgatatgtatgccctttgtattatcttcggggtggaaagaagtgaaaatagaagcaaattggttttgcagtaagtttagtcttttgacctgtaactggttaatttcgaaatgactggtggagcctaactcgaatatagagcaaagggagtgtttagtggcgtatcctcttacttcgatgatatttgaataaaggtcaactatcatctaccgattagtattcatattactactgtattataatatgggtgtgagaatatggcgtaacgtttgagagacagtctcaggtgtagtggaagctgaaattcaggggaatgatgttgtaatggaataattaatgagaggatatgagatggaaggaaatttaattatattattacatagaaatatcgatttctttttgtgaatttctatatcctcgaggaaactttctggtatactttgtatactaaattttatagcctttgacaacaacgaaatcccaaaaagtatttcataattcatgtacttacgagaagaaaaaccattgccctactagtgcttcaaacaatataattgggagcaactaaaatctccttgcaatgagttacaaggaacagattcttaccggtagtcctggtgagcaaaagacttaaccatgtggcagccgttgtctaatatccactagctatacacttacatggaatattggctgctgaaataattagacttaatggtagcaaacgtagtggtcatccatatgaatatatgagcaagaaataaacgtgaacatgtaaaatagtaatacagacaccataatgtacaggttaattctgatatgtttctcgaatgaaatcgggaagaccaataggaggctcaattctattttcactcacgttatgcgcctgaatttgaatggatgttgttgatagaagattccttttaatcactcccctatataaatatttccgtttttcttattaacgcaacaataattcgggcgtgtggtctagtggtatgattctcgctttgggcgacttcctgaataaacaggaagacaaagcatgcgagaggccctgggttcaattcccagctcgcccccttttttttgcatatctggtcaataatatcttatctgatccactagtagtttcctcatatattaattccttgtgcaatttttttttacttactcaatactaagcggttcttcataaatatatatactatactgtttattatttcctgttttcaacaatgaatagctttatcataggcagccatgttagcttccttaaatgcttcggacaaagtaggatgagcatggcagaccctagcaacatcttctgcggaagcgccatattctaaggctaagccagcttcagcaatcatttcaccggcatttggaccgataatgtgagcccccaaaatacgctcggtcttggaatcaatcaaaatcttcacgaaaccttcagtgtcttgattggttttggctcttgaattggccgcaaaggggaacttaccaattttatagtcgatgccggcttctttcaattgctcttcggttttaccaacccatgctacttctgggtgagaatacatgaccgaaggaatgttgttatagttgacatgaccgtgaccagttttcaacatttcgacagctgcaataccttcctcttcggctttgtgagccaacattggaccaaatgtaacatctcctaccactttaatgtgtgggaacttggaattaaattggtcatcaatgactaggcgtccccttttgtctacttctagtccaatcttttcagcccctaagccagcaatgtaaggtcttctaccaacagcaaccagcaaaacttcagcttccaaattttcttgcttattcgttttagtatcttctacaacaatttcgacgacgttcttgtcgtcgtttctctttgcagaaataactttggtgcttaatttgaagtccaaaccttgctttttcaagaacttttgggtggctttggcaacctcgccgtccatagatgcaccaatttgaggttgaaattctactacagtaaccttggagcctaatctagagtaaactgaacccatttccaatccgatgattcctccaccaatgatggttaatcttttgggaatttcctttaacgaaagagcacctgttgaagagacaattttttcctcatctatttcaataccggggaagggtgtaacttcagagcccgtggcgactatgatgttcttaacatctagtatgtggtcttccttgacagtgccttccaacccatcaacgggagttactctgatcttcgtttcgtcttcgaatgaaccattacctttataataggtgaccttatttttcttgaacagaagctcaatacctccagttaattgcttaacagcgtcatccttagccttttggaagtttgctacgttaattttgatatcaccgttgacgtcaatacctctcttttgcgcttccgtatgcatttggtggtataaatgagaattatttaaaagtgctttggaggggatacatccaacgttaagacaggtaccgcctaatttgcctcttttttctacacatgcagtgttaaatcccaattgagcagctttgatggcagccacgtaaccagcagggccaccaccgatgatgactacatcatgtgacttgttaatggtcaatgtcctgactgtggacgaaaaggcacgcttattatttaggagtgatctgattcttaacattgtgaactgttagtatgttctttgatggtacgacagagacaatcgaacaaaaccgtatatatataaatatacgttatatgtatatatatatctatatatattcgaggtgagtcaaagggtacgaattatcatcaaattgtttattagcattataatacactaagtttccattaagttgctccgcggagacttctcgccaatgagggaacagccgttcgagatgataaagtattctaaaaacgagtcatcattaaaaacgattcacgtgatattcacgtgcataaaccattagtaagtatatatttttagtgggatatatgagggtacattgcatcatgactattcgtggtagtcacgcatacgtttgtcagtggcgttgtttgagtattcctctgttcttcatttcccttttttcctgtaacctcacctacgctctttcacgtttgtgctgatagaaacaatgtggtaagaaaaattaaatctctaaaggtgcaatgaatgtataagaaagtacaacgcatatagagtatccggcataggacaggattacgcaaacacacgcacagatacaatggtttctacccctgaactgaagaaatatatggacaagaagatattgctgaatataaatggatctaggaaagtggcaggaattttgcgaggctacgatattttcttaaacgtcgttcttgatgatgcaatggagataaatggtgaagaccctgccaataaccacccgctaggcttgcagaccgtcattaggggcaactccataatatccctagaggctctagatgccatataaaattatatatatatatatatatatgtcgacctctatgtactatacagcaatactattttctaatttgcatttccacgcctgcgttgctaaacccacatttttcatagaatttgacatttttctcatcgcaatctaaaataatcttataacaaccgtagtcaaagccgatagttaccaattgatcaatcaagagcttgcccaaaccttggccctgatacttggagtttactgcaatgtcctcgatgtggccacatagccccagttcatgaatgatctttctttcgatgatgatattccccgtagcggcaaccgtctcggtgcgcttgtccacaatcaccatggggttatattgcattatttttttatcttcgttatcattccatactgtggcttcattccagtattttatgagtttgctgaaggattcgggggtaatagtgcccacggtggtcaaaacctttagcgtctcagtgacctgttccaaatccccctcttccattcgccttatataaaatccatcgggtaagctcattattttatgttgatatccagcttccgttcgtcaactattctctcgagctcagttttgggttttggcatgtaaacaatgccttcgcatgtattacgcaaaaaaaaaaaataaaataaaaaaaaaaaaaataaaggtataaatcgttggttcttttatgcacaattatttaactatnnnnnnnnnnnnnnnnnnnnnnnnnnnnnnnnnnnnnnnnnnnnnnnnnnnnnnnnnnnnatgaagtttaattttttttgtcacctttgatcttcctgaatgtgttggtaatgaaattttctagtctcttcaaagtgttgtcgtcatccttttttgcgtgtttttcctcttcttgtttttgtttcttcagtatctcttcattaatggctgtacccgcggctgtgcccggttgcatggttttcttggccatgtcatcgttggtgacatctgccagtgcctcccacaagcatttttctgccagcgattgcggtttcttaacaacgatcttgtactggactttcatatcaccgcgaatggttgatgttttaggaacacccatgttaggaatggatatcacttgattgtattgagtccctggagcgacctttatcctgatcttttgtccctccacagtggggatagtgacagtaccaccaagtgcagctgtggttataggaatctccttgtcgtaccaaatatcgtacttgttctttatcgaaaagttgggatccttgtcgacacgaattctcaccaaaatatcacctcttgataacttgactgaatctttcaagtccgcctctacagcgatgtcagggtatgagccttggccagggatcctgaccacgtcgccgtcctgtaatccatgtggcaagtccaccgtaattgtctttgccctgttgacctgaacaccctcaccgtggcacttggtacaattgtcctgaggccgtttcatggtaccttcaccgttgcaagtgggacaagtcgacatcatctgaaatccgcccctaatgtgaacagtggttcctgttccgtgacaagtgctacaactgaccttatgcgtgtttggtttcattcccgtccctgaacaggtactacaagggtccagcgcagagaatcttaactgaacgttcttggacccaaacactgcgtccttgaaagacactttatggacaatctcgattgggtcgcccctatattgtctgaacatagatgacgacctgcttgcgccaccgctaccgcggccaccaccaccaaatgcagcaccaaacaggtcttcaaaattgataccgccaaatggcgagccgcctgcactggtgaatcctgagaaatcatgaaattgggaaccaaagggagagccactaccaccaccggcacctccagcggcaccgccgccgccgaaggcagcgggcccaaattgatcgtactgctgcctcttcgtttcgtctgacagaatttcataagcgttctgtaaatcgtggaatttcttctcagcatccggttccttgttgatatccgggtggtacttctttgccagtttgtagtatgcttttttgatttccgcacctgtagcagatttcttcaagcctaaagtatcgtacgggtccttgaatgcttcgctgtttctgattgcagaagtatggaagctagattttggtattcgtggagcgatggatgcaaacgcgatggcatgtctataaagaatattattgatatggcgagaatgtcccacatggtgtctaaagacaccggaacaccttgacaatacaccttgttggaaagccattgttatgttatgtttagagtatgatataggacttctctcttcttttttttttttgtccaggtggagtgcgatttgttcgttatatgcctcattccttaatttttatcagtcagaacgttatttcgcgctgcaagttccttacttttccatagagttccacaggatgtaaagaaaaataatgataaaaaaaagcagaacatattacccttcttttggagcgtacttccatctgttacccgctcatccaaatgcacattgtgttaccctcttgttcggtatttttcggagttctccttttctccttcttttcctcttgatacacagaaaagtgggagaaggtagggggagtcagagaatgaagaaaaaaaggggacgcgcaaatccaagtgaaaatctccgggagcgggcggatcccactaacggcccagccgaaaatggaaaaaaagggtcggtgatgtgtgggtgccagctggcggtagcaatgacgacgtgttgacgggcccttggctcttgggacaaggactagaagccaaaagccagaggcggtaaaaatagcaagactagaatattgctggcatctgttaaggggatatgttgcaacttgcagggggcggcacaaaataacatagaaacgtagtaaagaggggaaaaggaaaaggaaaaggaaaaggaaggaaaaaaacccattgacgtagaaattgaaagaaggaaaggtatacgcaagcattaatacaacccacaaacacagaccagaagcactctagacggagagtaactagatctacagcccctggaaaatcgtttggtcaactttgaggttccggtcgtccccctcttgatctgaaaggtctttctctaaatctaaattaaaacgtataaataggacggtgaattgcgttctacttcctcaattgcgtttgatcttatttaatctctctctaatatatagaaaaaaaaaccatctgattattcgataatctcaaacaaacaactcaaaacaaaaaaaactaaatacaacaatgtctgacgcaggtagaaaaggattcggtgaaaaagcttctgaagctttgaagccagactctcaaaagtcatacgctgaacaaggtaaggaatacatcactgacaaggccgacaaggtcgctggtaaggttcaaccagaagacaacaagggtgtcttccaaggtgtccacgactctgccgaaaaaggcaaggataacgctgaaggtcaaggtgaatctttggcagaccaagctagagattacatgggagccgccaagtccaagttgaacgatgccgtcgaatatgtttccggtcgtgtccacggtgaagaagacccaaccaagaagtaaatctttcggaactctttgtagttacatggttttttctttatgatgtgtgatgttccttaatattatattcaatgaatagcagagtaataaaaaaattctaaaaaaaaacgcttaaatcgaggtggaatatataaactctaattcagtttaaaaattagctgtttttttaaaaaaaaaattctctttctttacaaaatgttcttaaatgtatgtatgtatgtatgtatgtgtgtgtgtgtgtgtgtgtgcgtattgttctatttcactccagcttaaacatggcggttgcttcttcgtcatcaatttccgcgcgttcgattttatttaaaagtactttctttgaagcgccgagatttttcatgaaatccgtctcaaatccaagcaaattatctttgaatttctttctctttttaccgcgaatcccaagcactgacgctacggggatgtcttcaaattcattgaatatcttgattaacccaatatcgcgtcttttcaacctgtttggcacctgggattttttcaaatcggcgagaaactcctcttgtgtcttaccattttctgacacatgcttgttcagatctagcgatattagcttgtcgaccttgtttaccgtagctgaactattgtattttttcaatggtgttagatttaaatcgtttttgtcaatgatagcagcggaggtaatttcttcttctgtttctgttggtgccgctggcgttactttgggcagttgtggtgtgacttttttcctgttcaatgtcatgggtgaagaagattccagtatgggcgtaggcgtcaaaagtgatctagtctcctctacagtctcttcgctcttgtcatcttccccttcaccgtcctcttcgctcttgtcaccaccgatactgggctttttcacctctgtaacattggtacgctcgcgcttcctaccttcctccatcttactcataaattctcttctcttgatgcgttggttggctccgaactctaattcatcttcaggatccgtgtcgtaactgcgttccgtacaccttaaaatgaactttccagaaggtgcaccatcttccaatccattgaaaaatcttactgattcttcgacctcctcctggcttaagtttgtctccaaatgaatatatagcagccaaatcaatatgtttgatctatcctttggctcgtatttcgaatagtccagtatatcaaataatgttgttgcataagctgcttttgattcttgtttttcattttccccttccgtttcttttacttcattctgttcatctaccatatcttgctcctgagctttcgattcgacttccacatacttggaaagaaacctcttgtcaattaggccggaattatcacatatgctaaacaacatattaataatgttaaatttgttaacggtgtccacttcaccattattttggtcgacctttttgtaagtttccatcaatgagagttgctcattgccccacggcagatttttcagaatagatttcagtctaggtgtatcctgcaaaagtttcggatcattggcatgtaattgtaaaactggcacggagtgaaaagttctcaattgcgatgtcatttctaaataaaaatttatagtggtgttcaacctaccaatgttgaccaataacgctaaaacacaagtagaaaacgctacttgttggtctaataatagtttatctctgagaattttggaacatttgatagaagtggctattgtcaacacatacaattgtgcgaacgtcaatttatcgttaaatacaaatgtccttgcatcgtactctttgtcggtcacgttgattgatactttatcgccatcaatattaatgggtacaatagagttcttgtataggggttttagaacattagtgaagatttgcctcttgtccatcaacagttcttgcatgaaactgaactgaatgtcctttctattgaatggctcgccgtcaggtttcttcaaatgacgattgtatttactggcattgctttctttgggtttccttctaacagtgttagttgtcactggccccgttgccgtacttgctcctgttgcttcaggcactgtagaaggttcgaagttgagcaagatgttggtattttcttcttcactttgcgtggagtcatcatcatttttatcgtcgatttcaatctcgtgtataactggaatgctttttgtagtcacagtctcggtctctgattgaatggagcttggggatgcttcttcttgtgatcccgattttacagattgcattggagaatctgcttttgtttcgtcagaattgtcttctcgtagttggaaagtatcatgaattggatcgtatactctcttccccatctttaattagagtgtcgcctttatttaactttcgattttacttagttaatcatgaactgtttccaataccatatcagcattcattgggcgttctttacttacttgtaccgttaccgcattcgagggtaacctgtttttcgttgtacacgatatgctacagaattgtcttaatatgggctaaaaaaaaaaaaaagtctgattatttctaatactgcaaatatatactggcttggttaagaaaagtgttgctttagttcctttacatcaagagtcgttaaattgttttgtgtcataacagtagtggtcttttgagacatcaatcgactctcaggttttccttctgttcatcttcttgttttcggtaaaggtcagcatatttcaattctctctttttttaaataacattatgtaatctttcagtcctttctatccaacgtctgctaaataatttattcaaatgacatgtagactagaaaatcgaacgttggataatttttcattctgaatcatgttggtctcaactagagcaattttttcacgtcctctgacacaaaactcgataaactgtcgcatcagtttaaaaaaatatgtaggtgtataataactgaatttaaaaggatagtaaataatttttgcattttatggaatgtcaaaacactaataagtcgcaaatatagctatcaaataccataatttagctacttatagaaagatgtccaaatcccgaccaaaaaggaccattgcgtcttcttcgtcagttttttatggaagttcacctttccaaaatgatggctacatcaaagtaatggaactcgtatcacacattgtcattgaaataaatcattcacctaccgcaacaacagatgaaacgagaaagcagaataatccggagctgaaagtgaaagaaccagtttgtaacctcaagaagtgggaaaataacactaactttatattggaagatcatacgaagaataaaacaaaactttctagcacagataggatacgtaagtggtttagaagacatatattaaaggaagagatcgaaatcctttcccatggaaaacaattgagtagtactgatgaggattattgcccttcaaatgttcttgtaggatgttcaagagatctaaataaactcaggtcatttcaaaatttttaggaatataaaatttctcagtaagaaaaagaagatgaatgcgtttatagtattttaagttgttcaatagagtatcttcaatatgttcatatgtggactaaaagaagattttggtatatgtctataaatttattgttggtaaacgccattaagcagctttccaagaaaatgttctcattgaggagaagtacgaaaacttattatgcacgattaggaaaaattctgcaaggagtattaaaaaatggccttcgagaagaaatgaaatctctttcgatgagcaatggtctaatggataatttgatagacatatgaaaaagtcaaaagtttttttggccatatgcagtaaaaacttacccttcaaattgcaaaaccattagttttattatattctttttttttctttcattgaagtatacacgaaatcccatacgcaaataaacagtcgttgtatcatcaatttcggctgtctggatggcgacaacgagaggaagcttgcttgccatgataggaccaatctcaatttttaatttttcatcaactagctaattttctataatgctctaagtttcctttttcgttttgtttctttatagtggtgacgctgttattgtgacgctatcaaatcatattactgtcatcaatcctcttcggctccggaacgcgttgaatatgttgttaaacaagctctttatagctagctatagtagaaaaggaaggaaagaagtctaatcgctgtattatcgactgacaagggttgtcagttgccttcttttattttttgtactcccctgaatcgagcggatgtattttttaacaaagtattcagaattgtttttgtataatcaaaatttgtcgacgctaagaaaatgacggacgtcgtaattccgctactaggttttgtgtgctcgtcgatatttgacacctattttcgacacttttaaggttatatactttgtttcggatgtggggtacactcagttgactgattatgaaagatatggcgtagccgttgtgttagggttattacacagaaatgaattataccagtgaaattattccctttttgtttgttcctacatgttttccaatcagaaggaattgttatataaggacacaaggaatgtgttggtacgctctgcgcctcaatgacggtttatctatctaaaactatttctttctcgtaataaaaatacaataaataattaataataatatagttgatcgatataacaaaaaaaataacagcgaggatggctagttcaagtgtttccattttggggactagcgctaaggcatccacttctctaagtagaaaggatgaagttaaactgacccctgaagcaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtattgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatatccaaattcaatacagtggcgggttcccttgggtttgtgttttgcgtgggcaatctttatggtgattggaatggttatggttccggaatcgccaagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaacttttctcaaacaaaggagcaattctaccaagggtaataatgggaatcgttatccagtcactgcaacagcttactggctgtaattattttttttactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatagtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttacggctatgttttcatgggttgtttaatcttttcgtacttctacgttttcttctttgtttgcgaaacaaaaggattaactctggaggaagttaatgaaatgtacgaagaaagaataaagccatggaagtccgggggttggattcccagttctagaagaacaccacaaccaacaagcagtacaccattagttattgttgatagtaaataatttctaaatattcttgtactctggtaaacagaaataacaacagataatggattgatgctttacttctatttcatggagattggttttatataatagcctttattaatggcgtcacaaattgaaaaaaaaattaaaaaaaaaagacggacacatttgcgacgccggtgaataaatgcatataagttgtttataagctagctactactcagaaataatttcaaaaaaaaaaagaagtgggcactttaaaatgaagattagctatagcaaattactgtagtataacaactagccgctatctttctgaaaaaatcaggcaatgtaaggtcaaacttgtaccatcgacatatataatgctttgagatataagtaactagagaccagtttatacaggatcttacctctttttaccgttatgaaagctttattactgcgttgttagtaaacacacatattattttcgggtagtcctgtcgatgttccaaggctttgcatttatcattgtttccgcttcatcggtggtattagttagtgtatctgtatgtgaagtatgtggacaggtgcttctattattggaacaaaacaccttaaacgcgcactaggttataggaaagggtccattattcaaagaacggcttattgaaaagtatgttgtaaagctcggtcatatcgcgcatagccacgataaggcgtggtgctgcttcatagattgagaggcgcagtcaatacacaaccataccggtagtttgataaatgatactatcattccggaagctctctagtaagctgtaggtggcatatacggtatctatcatctagtaatagctattgatttttttctcgactatgctatatgtgttgtgatggttcacttagaagtgaaaaagtagcaataaattagacagacagaagtaattgaagctacattcaacaatatggctaagtaaaaaagcgtagaatatcatgatgggttttttatcttttaattgctttctatgtagtataatggaccgatctttgcaagtatatatctgtatgtatccatatttagatggcagcaagcgatatagatttgatgagcttatatcattttatcgtccttgcccaaaaagtcttgataacattaaaagtcaccaccgtcaaatccatcatcaaatccgccgtcgaacccaccagcatcatcaccgtagtaattgttctcgacaacgacagtgtctggttcgtcatagttgtggtcgtcaaatgcgtgttctagcatagctccacctaacaaacctgcaccaacaccaagtaaaccacccatcatggcaccgccgtgtccactacctttactggtgcttggcgcagttccatagtatgcttgctgtggtgctgctgctggcataggggcttgttgcggatagtaacgctgctgttgagggtattgagggtactgaggctgttgaggctgatagtaacgaggttgctgtgcttgggcccgtgcttgcacttgcggtgttgattgagaagaataaggtggaggagcctggtctgcctgttgacgagaactcttctcattgttaacacctggtggaggacctttgggtcttggccatgttgttccccttggtggttcccactgagagctgttcgtagataaatctacataataccaagtctggtattcatcatcaaaaacagccttccagccagaaggcacttggggaggattacttttactttgagccattactttaaaatgttttgggtttttttatcgactctcttgtagtgagtgataaaagcaattcagaaatagtcttttgattatcatgactaaagtaaactttttcttccagctgccggctcggtcaggtggacgaaacaaaaaagcctgttgaaataatactgaatacgttaaaacgtcacagcgcttgtatatcttgtgagagaaaggctattaccactgttatatgaatatagattgctcaacaaagcgtgtctttttctgtgtgcttaaaatatagtgtcttttttgggaaagaaacgttcatttacagtattctcttcttcttctcctcattcaacttgttgcggttcgaagaaaattacgcataaagaatcaaagaaaggcaaaaattacgctgtacgatggggtcgtttcccttagctgagtttccattacgtgatattcctgttccttatagctaccgtgtgtctggcggtatagcttcctcaggtagtgttactgcgcttgttactgccgctggcactcgtcgaaactcgtccacggctaagacagttgagacagaagacggcgaagaagatatcgatgagtatcagaggaaaagagcagctggttctggcgaatccactcctgaacgcagtgatttcaaaagggtaaaacatgataatcacaaaaccctccatccagttaacttacagaacaccggtacagcgtctgtggataatgacggtctgcacaatttaacagatatatccaacgatgcagaaaaacttttgatgtctgtggatgatggttctgccgcaccttctacattgagtgtaaacatgggagtggcatctcataatgttgctgctcccactaccgtcaatgcggcaacaataactggcagtgatgttagtaacaatgttaatagtgctaccattaacaatcctatggaggaaggagcgctgccgttatcacccactgcttcctctccaggtaccacaactcctttagctaaaactacgaaaactatcaacaacaataataatatcgccgatttgatagaatccaaagattctataatctcccctgaatacctttctgatgagattttcaccgcaataaacaataatctccctcacgcatacttcaaaaatttattatttagattagttgccaacatggataggagtgaactatccgacttggggactttaatcaaggataatttaaagagggacctaataacgtctttgccttttgaaataagtttgaaaattttcaattatttgcaattcgaggatattataaattcccttggggtctcccaaaattggaacaaaataattagaaaatctacatcgttgtggaaaaaacttctgatatcggaaaattttgtgagcccaaagggttttaattctctcaatctcaaactctcccaaaaatacccaaaactctcacaacaagatcgccttagattatcttttctggagaatatattcattttaaaaaattggtacaatcccaagtttgtaccacaaaggaccacgttaagaggccatatgacgagtgttattacgtgcttgcaatttgaagataattatgtcattacgggggctgatgacaaaatgatcagagtttatgattcgataaacaagaaatttcttctacaactatcaggtcatgatggtggggtttgggcattgaagtatgcccatggcggtattttagtcagcggttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagtcctccgttcctgatcatggggaagaacatgattatccattagtctttcatacccctgaggagaacccatattttgttggtgttttaagaggacatatggcatctgtaagaactgtctcaggccacggtaatattgtcgttagtggctcctatgataatacactgattgtgtgggatgttgcgcaaatgaaatgtttatatattttaagtggacatacggatcgtatttattcgacaatctacgatcatgaaagaaaaaggtgcatctctgccagtatggataccactattagaatttgggatttggaaaatatatggaataatggagaatgttcctacgcaacaaattcagcatcgccatgcgccaaaatacttggtgctatgtacactttgcagggacatacagctttggtcggtttattaagattatccgacaaatttttggtcagtgccgctgcagacggttcaataaggggttgggacgcaaacgactactctagaaaattttcctaccatcataccaatttgagtgcaattaccacattttatgtatcggataatattttggtgagtggatcggaaaatcagttcaatatctataatctacggagtgggaaattggtccacgcaaatattctaaaagatgctgatcagatttggtcggttaattttaagggcaaaacacttgttgcagcagttgaaaaagatgggcagagctttttagaaattctggatttcagcaaagcttcaaaaattaactacgttagcaatcccgtaaactcctcgtcgtcgtctttggaatccatttctacttctttgggtctaacgaggacaactataataccatgacctttcccagagaacaagcattgactcatacttagataatatagcttaataagtagttatataatcagtaaaaaagtaaaataacaacttcgtacattttattgaatataaagtgcagctaaactgcttgtatgttcaattttaattgtgtttacaaaaaggtgccgtttattaattaatgtttcttccctgaaaacatggaaagtacaagttttcagttgagaagggtttaagaaagttttgaaaatgatttaaaaaaatataaaagcaatcaaagaaataaaagctggaaaaatgcgtaataacagaagtgactaaaatttctttacgcgccaaatgagaaatcgatgctcttgaaagtagcaaccattttttaaataatatattcctgatggttcttggcccaagagttttcttgaacttttaacgttaagaagttgattctgctgatttttttcaagttatcaagcgttatgttttgaaacatctgttccgttttcagtttttcaaaaagatcgatattctcttgagaattaggaagttctacgctcaacctcccgtgggcagaagaaatacaaaagctaatacaattgtgttagaataaagttctaatattatctaattagtagtattcatgttattatattatcacatgatatttctcaaattggacaatgtaaataatgagtgtttttatgacacaatctttatcgttagatgtttcaacgttccaagccttgattctatcgctcttctcttcaaattgtaatcgtttgtaatgataaacgcgtacgggaaaaaaaaaaagtatcaataacgcgtaaagtgaatagagtactggattctataagaccgaagacgctcatatcacatctcataaaatcacttaaagcaagcatccagaggctattgataaaaagcagacacaaggagacgcaatgggacgtttagttggcttagaactaagtaatttcaagtcctatagaggcgttaccaaggtaggattcggcgagtcgaatttcacaagtattatcggtcctaacggatctggtaaatcgaatatgatggatgctatctcattcgtactcggtgtgcggagtaatcatttgaggtcaaacatcttgaaagatttaatctatagaggtgttctaaacgatgagaatagtgatgattatgataacgagggcgctgcctcttcgaacccacaatccgcatacgtgaaggcattttatcaaaaaggtaacaaactggtggagctgatgaggataatttccagaaacggtgacactagttataaaattgatggaaaaactgtctcctataaggattattctatatttcttgagaacgaaaatattcttatcaaagccaaaaattttctagtgttccagggtgatgttgagcaaattgcagcacaatcccccgtagaattatcaagaatgtttgaagaagtatcaggttctatccaatacaaaaaggagtatgaagagttgaaggaaaagattgagaaattaagcaaatctgcaaccgaatctataaaaaataggagaaggatccatggagaattgaagacatataaagaaggtatcaataagaacgaggagtataggaaacaattggacaaaaaaaatgaattacagaagttccaggctctatggcagttatatcatttggagcaacaaaaagaggagctaacggacaagctgtccgcatcaaactctgaaatatcgtctttaaagggaaaaataaataacgagatgaaatcattacaacgctcaaaatcttcctttgttaaagaaagcgcagtaatttctaagcaaaaaagtaaattagattatatcttcaaggataaggaaaaattagtctcggatttacggctcataaaagttcctcaacaggcagcagggaagcgaatttcccatatagaaaaaagaatcgaaagtttacagaaagatcttcaaagacagaagacttatgtggagagatttgaaacacaactaaaagtggtgaccagatcaaaggaagcttttgaagaggaaatcaaacaatctgctagaaattatgacaaattcaagctaaatgaaaatgatttaaagacatataattgcttacatgaaaaatatctgactgaaggtgggtcaatcctagaagaaaaaattgccgttttgaacaacgataagcgagaaatccaagaggaattggagagattcaacaaaagggcagatatttctaaaagaaggataacggaggagctttctataacaggagaaaaattggacacgcaattaaacgatttaagagtttctttgaatgagaaaaacgcccttcatactgaacgtttgcacgagctgaaaaaattacaatctgatattgaatctgctaataatcaagaatacgacttaaatttcaagttgagggaaacgttggttaagatcgatgacttgagtgctaatcaaagagaaacaatgaaagaaagaaaactaagagaaaatatagcaatgttgaaaagattcttccccggagtaaaaggtcttgttcatgatctttgtcacccaaaaaaggagaaatatggcttggcagtgtctaccatcttaggtaagaactttgattccgtcattgtagaaaatttaaccgtagctcaagaatgcattgcatttttgaagaagcaacgtgcgggcactgcatctttcataccactagacacgattgagacagagttacctacattatcattgcctaactcacaagactatattttatcaattaatgctattgactacgagccggaatatgaaaaagcgatgcaatatgtgtgtggcgattccatcatatgtaatacgttgaatattgctaaagatctgaaatggaaaaagggcataagaggcaaattggttacaattgaaggtgctttgatccacaaggccggtttgatgacaggtggtatatcaggagatgccaataataggtgggataaagaagaatatcaaagcttaatgtctttaaaagacaaattactaatccaaatcgatgaactttccaacggtcaacgctctaattcaatcagagcaagagaagttgaaaatagtgtttcactattgaactcggacatagcaaatttgagaactcaagtaacacaacaaaaacgctccttggatgaaaatcgtttagagattaagtaccataatgacttgatagagaaagaaattcaaccgaagataactgaactaaagaagaagctagatgatttagaaaatactaaagataatttagagaaagagaaggaggctttacaaaataatattttcaaagaattcactagtaaaattggctttacaatcaaagaatatgaaaatcattccggtgaattgatgagacaacaatctaaagaattacagcagttacaaaaacaaattttgaccgttgaaaataagttgcagtttgagacagacagactaagtactactcaaagaagatatgaaaaggcgcaaaaggatttagagaatgctcaagttgaaatgaagtctttggaagaacaggaatatgcaatagaaatgaaaatcggatcaatagagtctaaattggaagaacacaaaaatcacttagatgagttacagaagaaatttgtaacgaagcaaagtgaattaaattccagcgaagatattctagaggacatgaacagcaacttacaagtcttaaaaagggaaagagacggtataaaggaagatattgaaaagtttgatttagagagagtaacagcgttaaagaattgtaaaatttctaatataaatatacctatatcatctgaaacaacgatagatgatttaccaatatcttccactgataatgaagcaattacaatttccaacagtatcgatataaactataaaggactacctaaaaaatacaaagaaaacaataccgattcggcaaggaaggagctggagcagaagattcatgaagtggaggaaatattgaacgagttgcagcccaatgcaagagctttggagagatacgacgaggcggaaggaaggtttgaagtgattaataacgaaacagaacaactaaaggccgaagaaaagaaaatattaaaccagttcctaaaaattaagaaaaaaagaaaggaactgttcgaaaagacatttgattatgtgagcgaccatttagacgcaatctacagggaacttactaaaaatcccaactccaatgtggaattggccggtggtaacgcttctttaaccatagaagacgaagatgaaccgttcaatgcgggaatcaaatatcatgccactccgcctcttaaaagattcaaagacatggaatatctttctggtggtgaaaaaaccgtagctgcattagctctattatttgctattaattcctaccagcctagtcccttcttcgtgctggacgaagtggacgcagccctagacattactaacgtccagagaattgctgcctatataagaaggcaccgtaatccggatctccaattcattgtcatttcattgaagaacaccatgtttgaaaaatctgacgctctcgttggggtttacagacagcaacaagaaaactcgtcgaagatcataactttggacttgagcaattacgcagaataatctatgaaaccaacctctgctataacccgtcaaataactaataatatctatataggtcaactagctagtgcaatatcatagtaacaataatattaataacgtcactttttttccagggtaacccaattgtggtgggtggcggccgaggtatcccttagaaaagaattttttaagttctttctcatctcttaccagtggagaagtacacgatatttgcaaagtctgtcatcagggcttgataataaagctgcattagatcttagcaaaaactacgagaagaacattgaatattgtagctgtatttgcatacataaactttatcattgttggttagctagctttgcacattaatttttcgatttgttaccgccaatgaccgctaacaatgacgatgatatcaaatcacccattcccattactaacaagaccttatcccaattgaagcgctttgagagaagtccaggaaggcccagttcttctcagggcgagataaaacgtaaaaagtctaggctatatgccgcagacggaagaccacattctccgctaagagcaaggtctgctaccccaacactacaggaccaaaaactgttcaatggcatggattccacttcccttttgaatgaaaggctacagcattatacgctggattatgttagtgacagggcccagcatatgaagaatatatatgacccatcatctcgctggttcagcagatccgtgaggcctgaatttcctattgaagagttcttaccatataagactgaaagtcatgaagatcaagcgaaatacttgtgccatgtcttagttaatctttatattgcgatcagctcattagatatacaaggtttgatttctatttccagtaaagatctggctgatttaaagaaagaagtggatgatttagctcttaaaaccgatcttttcaggttatctaacaacacagcggagaatgacttacttggtaacgatattgctgattatgacgatgcggaaggcctggaggacgaattggatgaatacttcgacttaacaggccccgactttaatgctaccggaaaaatcacagctaaatcagctactattgtgaatgtaaaccattggactaatgagctcaaaaattgtctacattttgattttccagtaggtttaagaaagtcgctagcgacagtttattattatttgtctcttgttcagggccaaaaggtgtatagacaaatgcatgtcgatatgttcgaaagattagtaagccttgacgatgataggacaaatttcactgaactgttgcaaaaacaaggtcttttgctagatcatcaaatcatgctcaatttcctgtgcgaatttctaccttatccagatcccgactatgctcgttatgaattatcatcaaaggaagatttacagttatttagattacttttgaagcatgcacataatgcaaaaccatttttcgataagtcaaaggaaagtttgttagttgatacgatgaattttctgttgtctagtcttgcaccatctactatgatggctgtcatgcctatcgttacatccgttgtgccctatcattatcatatccattctaagatcatcgattatttcccgttttgctatagcatctggagctcagtcagcgcaaacgtggccatcgacactcacatgtatgattttgttgggtcaatttccaaagacgttcataataagattttgagtagcgagcatgaaaaggatgtagttggagtggagtttggagaattcgggatttttactgatgatcaaatgacttttatgttcaataggttacaaggccatcttagaacagacggtcaaatacattcgtattctcgcacagtgaagccttttgtttatgctataaacggatcaaaaaaagataggttttttgaaaaacttgtaagtttagccaaagcaatcgaaacatttatccatccctctaataatgggttttggaccaagccaaatgctaaattcgttcatgcatttataaagtcttaccacggaagggtcaaatatgaagaagatatttgtgctaggggcgtcacaaatgggatatgtttaacttctttttgtcacgaagagatagttgaaatattcttaaatattatcagtctgggttcacagaataaaaatcctgatattgcgaactattacatctcttgtttcgcatatctgttagagctggatccttcaaatgcatatttaatttatgacaaaatactgatagatttgtacgatacgctggctgaccaatttatcaattcgagacacagaatcatttcctctttgaaacaatttacaagagtaattcggtttattgtgatggataagctatatcgcgtgcacataacaaacgtcctttcgatgctggtctccaaacttgatatgaacgatactaatttgacaagcaacctcatcaacggtattgtatctatagccgctttcattcctatccaagacctcactggggaggacgattatatatcgtttgaatcggatactcttcctttagttcaacaacatttttatcatattaagtgtggcgaaagttcaaagaccttccgagttgatgatgaactgttaaataacgctttcaaagcttccactacagtttttcaaagtatgctaaaagtatacatagaaaaaattttccaattggttgatgtagacttagaggactctttggttactaaaataaaccaaacaactatgattttacaagagtctatggacaataaaatatttaattattttgcttctttattacagagaaacttctggagtaatgactccttcaaggaaaaggatccaaactatgaattagttactatcccactagcggccttagtaagaaggaataatggtttgagtaaagagttggtcagaactcttttattccatatcaaagaacaaatcaaaagaggcgccgggtctgtaagaagtacttcagagattcaacagagggatgttaagttagttttatacttaactgcactaaatgatgtcttaaggcaatgtcatgaatctctattggagtatagcgatgagttgataacattcatgaaatgtttatacgacaacgtcactaacccgccattggatgttatcacatctattgttattcacagtgctttagcaactctatgtacaaccgaaataactgattgtcgtctattcccagaggactctaagattccggaaaaagacagatggggaggactacagttcgatcctcgaagatttgataaacagcatttgagttttcagtggcacgtaccttctagtgacgagataactttatccataagcattctagaaagcctttccgaatactgtattaacaacgtagaagaactgatgaaagctccaagacatgattccgaatatggcgatatgatacaaaaatatgttttagttatgacacatacgctttccgggtcaagtttactttttgatccagattttaacaaatataggacgcaatcaaacttatcatacagagagaaactgattttattaaagaatatacgcgaaaataattgtgaccctcaagaactggatattgatattgaacaaattcgttctggcaaggatgatgaagactatattgagagtaaggacattgaagcagggctgaatgcaggagtttccgatgttgtgcagttaagagatgagtttccggatgaattaattgttgatgaagaagtagtgtctgagatgccatctggtgtaaatactcctatcgcggggacgcatggcacggacaattcagctatgagttctgatctagctttcagggatttagatatttacacctgtaattattacttcggaaataccactgaggagaagttacaaaacccacaatatttacaagtccacagagttagagcgcgcattggacatttctttcacaaactctatgtttttttatctacaaacttcgaaaacaacaccaacatgttccaaattctattgcacggattgaaagtttggttcacagatctgggacaagaaacggtcttcaatgaagacccaaatgcctttattgacgttgatttcctagaaaacgttcaatctctctcacacgtaaatgagcccttcacgagaaccaattttgcaatcagagcaaacagtttgcaccagagtagagttctattacattcaacaaatagaaaagcttccaagctggaaaacctattgttagttgacatcatacagttagcgacatccctttatcctgatatttataaaccagcacagggaactttggtacactgtatgaaacaattagttgggtcatatggcgtagtcatcaataaaattattccatcattagagaaggcaattaaggatcatgattatatgaaaatccaagttattttaaatgttttgttaattaagaaaatccataggaagcttatgacggattataaagacatcggcagattgatatttctgcttattgaatgttgtcgtgtgaatgaattagagattggtatgtatgcagataagatcttaactgacatagtgattgggatcaagattccttctagtgtatgtgtcatttccgatcaagctttcctacctttagcacctcctgatggtactattaatttgcaagttgaagcggtaaagcttgccaaaaagaaaaagcgtgagtactacctctctctgttagtggatttgcaggacaaacttttagacaaattagataatgaaaaagatatggggtggaagataagaatgttcattttacgttttgttacacaaatccaatcgaacctcgaaagcaaacccgataaaagagcagtattttcaataatctcccaaatctccacaaaacatcccgaaatcatacatttggttgtaaagtcattgttgtcgacgtgcaacaagataatatctctctctgactatgaatatgacatcaccagggcctataagaatgaattcaatccatcatttgtggaaatactggacacttcgaccacaagcttccctaaaacgtttactgaagaaatgaataactttgataaccccaagtattttatcgattcgagggcgtatgtagggtggctatgttggggaaggcttatgtacgtcatgtcgccgaaacctttaaagctcaatttacgtgagaatgaactggaagtcctcaagacagctggtcatctattgacaagagaattcctgagagatgttacaatgaatttagtccaagataatgaaactaggggtgtttttagtagtggtaacgtgtcatttttctctttagtaatccttttgatatcatctggtttctgcgaactgaatatgtcggatctctttgagctatgtgaatcctactataacaaagacgataaggcttcgatgatcatgtctgtcgagatagtggctggcttagtttgcgggagtaagtttatgtcagtctctgacttggacaaacgtgacacttttatcgaaaacttcctagccaaatgtttagattatgagttgaaccatgacgcatttgaaatttggagcaccttggcatggtggttgcctgcagtcgttgatttaagaaggtctaaaacttttttttgccattttatcaacgccgatggcatgtttgaccgtgaatctgatgcagccacacatcaaacctccaaaatttacatgctaagaagtatcttgatgagcatggaatttagagccccagatgttggtaagctatttgatgagttggtatttgatcacccatacgatcaggttcgccaggctgtcgctaaactattgacgaccttagttcaaaatcaaagtaatccgtcaatttcagatccaaccacattattagaagcagaacggaatgatccagatggattagggttaccattaaaaagcgtcccagaaaaggtggatgcctatattaagaagcagtttgagatcattaaaaatctggaagattccgttgtcggcttgaatcctcaacaatttattaagacagactatttttacaggacatccacaatattttattggatcaaagaaatggcgagagggcctaataaagttttgttaattccatatttagtcgattatgttttaccatttctgatcggattagtgaaacataaagatgtttgtgctcttgccagtttagatcctgttcgattgtatgccggcttgggctatatgccgatcagaaagaaccatgttgccgccattgttgactatgtttgttcgtcaaatgtagcactatcttcaaaccaaacgaaactacagctagctttcatgcaacactttttatcagcggaactgcttcaacttactgaggaagaaaagaacaaaattttggaatttgttgtcagcaatttgtataacgaacagtttgtagaggtgagagttcgtgcggcatccattttgtctgatatcgtccataactggaaagaggaacagccgttgttgagtttaatcgagagatttgcaaagggtctcgacgtcaacaaatacacgtcgaaagaaagacaaaagttatccaaaacggatatcaagattcatggtaacgttttgggtttgggagctattatatcagcgttcccctatgtttttcccctaccgccatggatacccaagcaactaagcaacttatcctcgtgggccaggactagtggtatgactggacaagctgccaaaaatactattagtgagttcaagaaggtgagggccgacacttggaagttcgatagagcatctttcaatacggaggaactggaagacctggagggtgtcctatggagaagttactatgcctgattcatattagtataggatattaagcacatatctagacatatatgtacatctaaacaaatagctggagctatctgctgattagttttactctaaaagtaagttgttagtgtaactatgatcacggctgcgtgccgggtaataaatcaattttgaggaaaactggaagttcaccactgagaatgatcaacggcagggaaacgttataccaaacaaagcattctacctctagggaagctggaaacttgaattacccactatagcttgtcttttagtgatccattattccaacctattgcaattccaagaaaataaactaggaacttttttttttggaagaataagaaaaggagaaaaagtagacatactgtatatacacgagggcgtatcgttcaccagaaagaatataaacataacaagataaacatgtcaggcttgagaactgtttctgcttcatccggtaatggaaagagctatgactctattatgaaaattttattgattggtgattctggtgttgggaaatcatgtttattggttcgttttgttgaagacaaatttaacccgtcattcatcaccaccattggtattgatttcaaaataaagactgtcgatatcaacggtaagaaggtaaagctgcaactttgggataccgctggtcaagaacgtttccggacaatcaccacagcgtattatcgtggtgctatgggtatcattcttgtatatgatgtgacagacgagagaacatttactaatatcaagcaatggtttaaaaccgttaatgagcatgcgaacgatgaagcacagctactgttggttggtaacaagagcgatatggagacgagagtggtaacagctgatcaaggtgaagccttggctaaggagctgggtataccattcatcgagtccagtgctaagaacgatgacaatgtcaacgagatttttttcaccttggcgaagttaatccaagaaaaaatcgacagtaacaagcttgttggcgtcggtaacggtaaagagggcaatattagcatcaatagtgggagcggaaacagttctaaatcaaattgctgttgaagaaaagaagatttttgcttctttgagaattaatcgtgaactggaattagagctataaatcgcttgattcttttttccctttttctcaatattcgcaggttatttttcctttatatatatacattgtttgtatctttttttgattaccatacttactatttttatattagtcatattagatgtcacttttatattatctaaacaattcaaacttctcatactaactttttcagcatacttctactgttgttctctactctggaaggtattttcatcaggcgattggtaaaaaatcaagaaagaatctaaaaaaatagtgcaacaggaaaacgaggtacccagtttccctgggaattcttatccaggtatatattttacttttaagattcagcacttttatttcgttctaatgtttttaccggtagtaaagttttgcttcttgaatccactattcaactacttgcgcttatgtaaggttcctgtatggttgcataatcactcaattcgaaaaaaaaacccacgtgctgcttggaaatgaatccgcactgcggtatagcacttccagaaagatactgactgcgaaattcgctttatggagtgtttaagcaattggtatcttacccattaagagtcatttctttcttcttgccaacttttttccatcccattatgacctcaaaaaaggcaggctctcttcgtcttatcttttctatcggaagcgaattactgggaaagaggcataggtataaacagataaaatagacgaaaagagtttagaaaaaaaagtagaaagaacgactacacctcaacataacgacacttttttgacatgctgtttggagtgaagttggctaatgaggtttatcctccttggaagggttcttatattaattatgagggcttgaaaaaattcctgaaggaagatagcgtgaaggatggaagtaacgataagaaagcacgctgggacgattcagatgaatccaagtttgtggaagagttggataaggaacttgaaaaagtctatggttttcaactaaaaaagtacaataacttgatggagagattgtcccatctggagaaacaaacagatacggaagcagccataaaggccttggacgctgatgcattccaacgtgtattggaggaactgttaagcgagtctaccgaattagacaattttaagagattgaactttactgggtttgctaagattgttaagaaacatgacaagctatatccaaagtatccatctgttaaatctttgttggaagttagattaaaggaattgccttcccattcggaagaatattccccattgttgtatcgtatttcatttttgtacaacattttgagaagtaattttaacactgcatctgaacccttagccagcgcttctaagttttctagcattgtcagcaatgacatagacatgaatttcagaagctttaaattttgggttcataatgacaacttaatggaggtcaaaacaagaatcttgagacatcttcccgtgttggtctacgccaatgttccctccgaaaacgatgacctggtcaatagattcgaatcagatatatcaaataatgatgaaattgtgggtagttcgagctccactagtagcgtagaacatggcttgggagcgcgctccttcgatccattaatcaacacgctatattttgacaatgaacattttgaattatataacgacaagttattaaagttaaattcagcacctactttaagattaaggtggactggccagttatctgataagccggatattttcttggaaaagaaaactcttattgaagacgaagccactgggaagtctgaatttgatctaactaaattgcaattgaaacaaaaattcattaacgggtttattttcgaaggtgataagaaatttaaagaacaaactttgaaaaagttaaaagaaagtggtacggcagggagagacctggaaaggttagaagaagatttctctgagattcaaaactttattatcaagaatgaattgcaaccagtttttagaactgtttacaccagaactgctttccaaattcccggcgatgacaagataagagtaaccattgactctaatattgtattcatcaaggaggattcattcgacagagagcgtccaattagagaccctaatacctggcatagaactgatattgatgccgatgttgcaaatcccttgaaattcctgagaggaggcgagtatgctaagtttccttattcagtaatggaaattaaagtgaaaagttcattggattcttcgatgtctgccagttctatgatttctaatgtaaaactgcctaaaaagcatggtcaatggctgaacgatttgacaaattctcatttggtcaaagaaattccaaagttttctatctttgtgcaaggtgtggcatcattgtatggagatgatgaaaaattagatatcttaccattttggttgccagatttggaaacagatattagacaggatcctaagcaagcatatgaggaggaaaagaaaaaactgttgaaacaaaaagagatacaaaagaaaattgatggaatgagaaggctttccaacttaaaagagcctcaacatcaagcagcagtaccggtatctcaagaggaaaatgagcgtattacctctcaaggtgatttggaggcagacggttcatccgatgaggaaactgagcaagaacctcattcgaaaagatcaaagaaagttcggagaagaaaacccaaggccactttcttgagaattttggccggtagagatccaaagttaatgggggtggattctgaagaagaagaaattgaattgccacctggtgtgaaaaaaccattaaatttgttaaaaaatgctggtcctgtaaacgtggaggcaaaggtttggcttgccaacgaacgtacatttaacagatggttaagtgtcaccagtttattgagtgttttgacgttctcaatttataattctgtgaagaaagccgaataccccactttggctaactacatggcatacgtatattttggtctaacgatattctgtgctttatggtcctattccatttatatgaaaagagttgatattattcaacaaagaagcggtcaacatctagatgcaccacttggtccagttttggttgctatagttttatttgtcactttagtggttaattttgttatggcgtttagaaatgcagcaaagtctcgtcaagagttgcaaatacagaatttagaagttcctgaaagaataccagaagtattaaggccacttcaaaattatctattcaagttaatggggccaagcagtgattagaatatgtactctatctactgagaccatgtgtttttatgtttgtaatgtgtagcaaaaaattatcatctgctaataattgcttacttttagaaatcacatttaaggggaagttttaaatcattcataaatatcaatgcatttacataaacatcattttctccggtttttgataactctgtacagaaataatggattatagttttaagctaagcggaaaagccaaattattcttcaaaattttcgatgaagtcggagtttatttcttttaatttccctaaagtcaagggctctttttcatttcctgcacattctttcaatatcgctacaagattgtgtattctcttcatttggtttatggtcttttgatcaacaacgccatttgaatcttcgttttcagtccttgcttttgcaattttcaaaagcgaatggatattgtacgcttctgcaataatatccgggttgaatattttttttaccacccttattccactattctctattgcgacagatttctgggtcaactgataattcattttgacagaattgtcattgagaaggactgcatccatatgaagatgggaaactgctggcttcttagacattattttaggaatgtcctggaagtgtgtagaaagaaataccgttgcctccgttcgaagtaaatgttcagttactgccaaagacacacaaaacccatcagcgatgcttgaaccacgaccaagttcatctaaaattaacagtgtttctgtatttatgtcatctaaaaagtaagccatttctttcatttcaaaaccaaaatttgatgaggttaattccatactgtcattgcagactcttgcatgtagacgtttaaagacaggaaaagacccataaagtgccggtatacctgatcccatttgggccattatgcaaataagggcaacttgttttaaataaacagattttccactcatgttgcatccggttatgatttgtaagctggagctatgttttgtacttgatatggtgttagggacaaaattttttagtaccttttcaagtagtgggtgtcttgaatctcgaattagtagattgtttgtaaaaatcggtattgtgtaattattttctttcaaattatatgtgaatgaacaaaccaaatccaggatagccactgcttctgcaatcataaatagttcagaaatatgagttgcaattttatcgagcagttcatcaactgtctcttcacttaaaagcaaaatctcttccataacttccttcaacctcgcatttttttttattatatttagggttgtacattcaatataatttttttttattgttcttgaaatgaatacgtctggaagtgtagcgacgtcatcggtaaattcctgtctttttattctgagataaaagcctcgtgcagaatcgtaattatgatctaaattgattttgtttttagcggtaagatcttctacctcacgaaaaaattcctcttttacctctttgtagatttgtctagaaacatccaaaagcccattggaatcacttttcacagcatatgaacgttggttaagtagttgtatagctgaggatgcccaaacacagtcttcatttatacaactattaattaatttttcaatttccataattgcgtcattattgaatatttttttggtctcgctaattaaacggctttgaattaactgatcgttaagtgcgtctttcaatgacttcacgctttgtaaagtttcctttagcaacaaaacgtaattaattctttggtcaggttttattgcagaatgattaatgcataataaccttgaaaataacttatctagatcaggcaatgatttcatttctagccttaatttttgtagaaggtcatcattggctttcaattcttctagggcctctagtctcatttcgatactgcccctatcagttaatggctgcagtatactgttccgaagtgatctttgtcccattttagtggacgttgtatccaagaacttccatagtgatatgccattcttatccaatttattttctacaagttctaaacctctgacggttttagaatcaatcagcattgtattttctgttccttcaaactgtatacgtagttttcgaaacgcattcaaatttcggctgcttttggatataatctcttccatgtagcttatcgcagcagatgcagcacaaagagcaaacgttttatctataatctcctcgattttcaagtccttttttgtatcttccattaaatactttgtaatcgccgccagtccatcttggctattgaagcactttcgtgaaccctcttcaattttaactgtctcggccacattaaattttatcattgtcgctaattttgatactgttggagctagagaactgcttggaatcagtatttccgtaggttggtaaatttggagtttatgaactacacgaatgtaaatttgtgaatccatgaaatctgaaagatacatctgtcccgtgttacagttgataatacataacccaatccgcgtacttatgtctcttggcacttcgtatatgcaacaaagaacacagtcaatactaggaccgaggagtgaagcgttggtgctgtatcgacttaaggaggttgcggtcctagaggccattgatccagtcattaagtaatggctatgtgttgaatctttttcattgttttcccatgtcgtctctgctatttgtagcgttttctttttgagagcccaactacttatgttagttggcgatttttggttcctgatactctttttcgtacttggcttcgaaatagagtttgaagaattagccgccgaccttaaattgaaataatttgtactgataaaactagatagattagattcactcattgcatatagtttgcgttgatcagctacagatttcaatgctataactagttatttttatatgtttcactttaagtaaaatccaagtgctcttttgctattcttcgttgatgccttatatgtatgaaagctgtacgttcgggatttgaaaaggaaatgaagacgcgaattaaaaaaaaataataaactggttcatagcagaaaagaggagactaaataagattttgctctcatacagatgcaacacataaaaactttaatcgatttcagtatggaaaaagatatgatacaataaaatctaaatcttagaaactgattttgaataaaaaaacgaccccagtgagggttgaactcacgatcttgcgattaacagtcgcacgccttaaccaacttggccatggagtcagtcacttttgagttctgcaactcttaaaacggaatagaccacgtaaaacaatgtcatcccataccaaaacaataccgatttctcaaaggcatcgcaaacctctggaataaaaatccactatcatctatcaactaatagctattcaatatattatcatatacagtgttagatgatgatgttggaataaaaatccactatcgtctatcaactaatatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctagcctcagaatgttacttctccatatctttgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaacggaatgaggaataatcgtaatattagtatgtagatgatagttgatttctattccaacaattatctaattacccacacatttctcataatagttatatattatcatatacggtgttaagatgatgacataagttatgagaagctgtcatcgaagttagaggaagctgaagtgcaaggattgataatgtaataggataatgaaacatataaaacggaatagtctaatattagtatgtagaaatatggattccattttgaggattcctatatcctcgaggagaacttctagcatattctgtatacatattattatagccttaatcaacaatggaatcccaacaattatctcaaaattcaccaatatctcacagactatatctgaaacaaacaaagacgtatagtccaaagcaatattcaaggaaactacaaagtgagattagctacgcagaaataggagaaaaagtataaatttaaggttaaattcagatctcaaattctcttaatatttgaaataaatccgctgcgtgacaaatcccgtgatctcggaatatttatatgttaccatttatacatatggtataattatactcactaatgaatgtacgattactatttggaacaagtggtcatcaattgccatagtaatattttgaatgcttgcatcgtgcatgaatacataccgcgtataggtttaagcatgaatatacctattaaagaaaataatgaatctgtattgaagaaccgtacgttagacatgatctggtcgttatatatacgcgtaatatgactagtcatactaaatgtatgacaagttccagaactactattacattgatcataagtaataatacaaaaatcagcgtgtgttttatacttctcttatatagtataagaagatccatatttaatcttcattaatactacttcttaacctctaattaccaacgagtcaatgttaggataattgttggcattccattgttattaaagggaatcaaagtatattaaaaattcttcccaaggatgcaataacctaaaaaaggaagcccatatttctatataatgttattaatatttcctttttcatattattgtcgccactcattattccattacattatcaagtcttgcatttcggcttccattaaatttgatgattgtttctcagtctttgtgccatctactcacactcaattttaatatagtgttgatatgaatactaatcaatgagcgatcattggttccattacaataacgttgtgatcggaacttagtttgaagttattcctgtcgactgcctgatgtcagtattaaggctgtttgattatttctgaacataatatccttttcctgttacaagtacatgctgaacaagagatatatattatactttaagatggagtataatggttttagaatattttaaattaagtatgcatacacaaataatctacttactcactatgatgctaaaagatcatccattggttaagaatgttgagtgattccacgaacaaggtaactttttttccataattataagtcgtcaaaattgccttggatagctttgctggaaactttcttccgtttattctgtaaaacgatttctttccaatcctctttaatacgctcttcttcagcattttcatcgagctcttctgctttcaattcttcctctatagccttcctttttaaactcatcttttcctttctctcgagtttccgttctttcgtcaatgttttatctgaccacgctaaattcttcttcttcaactcacttttcagcttctttttatcattaatcaggcttatattttttaatgtttcttgtctctccttttcacgttttttgtccttgtatttatattcatccatattaactgggggatcgaccaaccaattccctgggaaaatcccttcttgtttttcggtggctaagtactttgttatctcaggcattctaggtaggcggaaaagaccatacaattttgcaataccaacataatctaaagattgaagcctaaaaattgaagttgcggaatgatttgagtagtatttaataaaggcaacatatgctttaacacctttatcaaatctatccctatcttctagtatccaatttctaaagtcctcgtaaaagtttgttgttatgccctttacttccaaatcaagttcttcaagttccacatttttaacttgcatgaaaggaataaaatcctcttctctgccttcattaagaaacgtaattgctttacccactctatttgctctaccagttctaccacatctatgcatgaacatatcagtattggtaggaggatcaagctggatgacgagatcaacgtcgggtatgtcaatacctctagcagccacatctgttgtgaataaaacagaattacttagcgaatcagtaaaagctgttagagtttttgtccttgccgatgtttgaagttttccatgcaaggaaaatacttctacttcattcacgagaatatttctctttcccaaatactggataaatgagtagaagtaggagactgacacacatgttggaaaatatacaatacatttcttgaatttgtagttattcaaaatgctaaccaaaagttgtagtttttcggcaggatttacgacacagtaatttaatttcaaagaggagggcgcctggttcttagagttaacggtaatcctgacaggatttctaagccctgtcttaaagatatctgatccggcgctacgcatagttgcagaaaataaacccgttcttctttgtttaggcaatagcctcagaattttttcggtatccttaataaaactcatatccaacaatctgtctgcttcatccataactaccatactgcatgctgacgtctttactgctggcatttgtaaaaagtccaaaactctaccaggtgttccaatcagaatctgcggtctattccgcagaaaattacttacatcatctctgactgtggcttcattagtaccaaccaggagctgacatttaatagggaacaagtcggaaggataatgttccagaaatgatagaacgacagactcaatttggcgtgacaattctcttgttggagcaataattaacgagtggaagtgtgctttcttgaattttgatgtattcgcttcttcctttacaactttttctagtacaggtataacaaacgcagcggtcttacctgagcctgttacagaatcaactactacatccttgttgccagcaagcatgggaattgtcgatgcttggactggagtcatggtctcaaaacccataacatccagtcctgtccttatccaaggaagtaaagaaaacccgagattatcccattccaatgattttgacattgtttttattgctgctgagcttttaatattatcttactacacctcaaatcaatgggctcagctcatcttgaaaagctcactttgtttttcagtgaaaaatttttgaaagcgaaaagccggctcaaaataaagtataatatagtattgtctcgaggtgcccacatgcaatctttactaccctactataatctcccttgaatgagtaatttcgttagaaggctagttgggaaaatgaaagcggtttcaacaggtaccaatgctattgttagtaagaaggactccatttacgcaaactggtccaaagagcagctaatacgaaggatcactgaactagaaaacgcaaataagccacattctgaaaaattccagcacatcgaggataacaaaaagcgcaaaatttcgcaagaagaggttacgagaagcaaggctaaaaaggctccgaagaagttcgacttttctaaacataataccaggttcatcgccttgagatttgcctatttgggatggaattacaatggcttagctgttcagaaagaattcacaccgttacctacagtagagggtaccattttggaggccatgaataagtgtaaacttgttccctcgatggttttacaagactataaatttagcagatgtggcagaacagacaagggagttagcgccatgaaccaagttatatcgttagaagtccgttccaatttaacagatgaggaacagcgggatccgaccaacgacagcagggaaataccctatgttcacgttttaaatcaattactacccgacgatattcgtatatcagctgtctgcctcagaccgccacctaactttgacgcaagattcagctgtgttcaccggcactataagtacatctttaatggaaaaaaccttaatattgaaaaaatgtctaaagccgcatcatattttgttggagagagagacttcaggaatttttgtaagcttgatggctcaaaacaaattaccaattttaaacgaacaataataagctcaaaaattcttcccctttctgaaactttctattgttttgatctcattggttcagcattcctatggcaccaagttcgttgcatgatggccattcttttcttagttggtcaatcacttgaagtgccggaaattgtcttgcgtctgactgatattgagaaaacccctcaaaggcctgtttacgaaatggcaaatgatataccattattgttatatgattgtaaatttcctgaaatggattggcaagaacctagtgtagatgactataaggcaataaaattcacgacagctactgaagcattgacgttacactacgaacttaaggccgcagtatgcaatatttttaaagatgttttgcccacagcaaatacaaacaacttctcaaagacaattattaatttgggcgatggaagaggtaaagtagtcggtagctatgtgaaactagaggatagaagcgttatggaacctgtcgaagttgttaatgctaaatactccaagaaaaagaacaacaaaaataagtaaaataatatataaacctgtataatataaccttaggagattatatttctttttatcacgtgctataaaaataattataattttaattttttaatatatatttatacactaataataaaaagtaaaaaaagaaattaaagaaaaacgaggttttgttttccgaagatataaaataggttgtaagttagaaattagtattataataacaaaaaaaatttaaggttagaaattagaattcaaggccttacacacgtttacgatgatattggacgaccgacacgaaaagacagttttaagcttccttttgtcttgctcttgcgttgaaagtacgtaatttccattcgattacttactcaacacttgatatagagatcaactataaaataaactgtttgggaaggaaagcagaactcttgtaacaacctcatctcattatcaagaagcaaaattttaactatgtattttgaccttatttttgtactccactttttttttttagttttttttagttattttttaattttgaagtaacggcgatgaggtgaagttttttttaaactgaaaaagaagatcgaatgcaaaccataaattagagatctaattgaggtaaaattataaggttagatatctgtaaatctatacaattaaggaaagatggcaccaaagaaaccttctaagagacaaaatctgagaagagaagtcgcaccagaggtgtttcaagattcacaagctaggaatcaactagcgaatgttcctcatcttaccgaaaaatctgcccagcgtaagccttctaaaaccaaggttaaaaaagaacagtctttggctagactttatggtgcgaagaaggacaagaaggggaaatattctgagaaagacttgaatattccaacactcaatagagctatcgttccgggtgttaaaataaggaggggaaagaaaggtaagaaattcattgctgataacgacactctgactttaaaccgtttaataacaactattggtgacaagtacgacgatatagctgagagtaagcttgagaaggctagaagattagaagaaatacgagaattgaaaagaaaggaaattgaaagaaaggaagcgcttaaacaagataaactagaagaaaaaaaagacgagattaaaaagaagtcttcggttgcaaggactatacgtagaaagaataaacgtgatatgttgaaaagtgaagcaaaagctagtgaaagtaaaactgaaggaaggaaggtaaaaaaagtctcatttgctcaatagtttgattgactaaactaaatacggataagtctgttgtataatatataacatcctgaaggcaaagtctttgtaaagattgtgctttatagaacggtcaatatcgtcatggctgatgctacactgttcatcacttctcttctatatcgaagaccgggtaataataaatatccgaatttttttcaaattttgaaaactcactcacgtcttcctagaagatttcaaatgcattaattcatcaaaattcaaaacttaacaacacttgtgaagaaaagtcacaaagaagtaaacgatatgctggagacgttgcgcggaaataagctgcattctggcacctcaaaaggcgccaacaaaaagttgaatgaactcttggaatcgtccgacaatctaccatcagcatcctctgaattaggttcaattcaagtaagcattaatgaattgagaagacgtgtttttcaattgagaagcaagaacaaagctagcaaggactatactaaagcccactatttattggctaacagtggcttaagctttgaagatgttgatgctttcatcaaagacttgcagacgaatcaatttttggaaccaaatccaccaaaaataattgaaagtgaggaactagaattctatataagaactaaaaaggaagaaaacattttgatgtctatcgaacagcttttaaatggcgctacaaaagattttgataattttattaatcataacttaaatctcgattgggctcagcataaaaatgaagtcatgaaaaattttggcatccttatacaagataagaaaactgtagatcacaaaaaatccatcagttctccagaccctaagcttccaagctggggtaataagggcaataacattttaaatagcaacgaatccagattgaatgtcaacgaaaataatatccttagggaaaagtttgaaaattatgccagaattgtgtttcaatttaacaatagtagacaagcaaatggaaattttgatatagccaacgaattcatctcaatattatcttctgcgaacggaacaagaaacgctcaattgctagagagctggaagattctcgaatcgatgaaaagtaaggatattaatattgttgaagtcgggaaacagtacctggagcaacagtttttacaatataccgacaatttatataagaaaaacatgaatgaaggattggccacaaatgtcaataaaatcaagtcattcattgatacgaagttgaagaaagcagacaaatcatggaagatttctaatttaactgttatcaatggtgttccaatatgggccttaatattttatcttttaagagcaggtctaatcaaggaagcattgcaagttctagtggagaataaggcgaatatcaaaaaagtagaacaatcattccttacttatttcaaagcatatgcttcttcaaaggaccacggcctaccagtggaatattccaccaagcttcatacagaatacaaccaacacataaaaagttctctagatggtgatccttatcgtctagctgtctacaagttgatcggaagatgcgacttgagtagaaagaacattcctgcagttactttaagcattgaagattggttgtggatgcatctcatgttgatcaaagaaaaggacgcggagaatgatcctgtttatgaaagatattccttagaagacttccagaatataataatatcgtatggaccatctcgcttctcaaactattacttacagacccttttgttaagtgggctctatggattggctattgactatacttatacatttagtgaaatggatgcggtgcatttggcaatagggctagcaagcttgaagctatttaagattgatagctcaacgcgcttgaccaaaaaacccaaaagggatatcaggttcgcaaacatactagctaattataccaagtcctttaggtattcagatcctagagttgctgtcgaatatttggttttaataactctaaatgaaggacctaccgatgtcgagttatgccatgaggcgttgagggagctagtattggaaactaaggaatttactgttcttttgggtaaaattggacgcgatggagctagaattccgggggtgatcgaagaaagacaacctttattacacgttcgtgatgaaaaggagtttttgcatacaattacagaacaagcagcaagaagggcagacgaagacggcagaatatatgatagtatattactgtaccagcttgctgaagaatatgacatagttattaccctcgtcaatagtttattaagtgatacacttagtgcgtcagatttagatcaaccattggttggacctgatgacaatagcgagacgaatcctgtcttgttggctaggaggatggcgtccatatattttgataatgctggtatatcgagacagattcatattaaaaacaaagaaatttgtatgctgctcttaaatatctcctctatcagggagctatatttcaataaacaatggcaagaaacactatcccaaatggagttattggatttacttcctttctcagacgagctatctgctagaaagaaagcacaagatttctctaatttagatgacaacattgtgaaaaatattccaaatttgttgattatcactctaagctgtatatcgaacatgattcatatcttgaacgaaagtaagtatcaatcgtccacaaaaggtcaacaaattgattccttaaaaaatgttgcgagacaatgtatgatttatgctggtatgattcaatacagaatgccaagggaaacgtacagcactttaattaatatagacgtctctctatgatttttttaaatattgtatatttttgtttatatctatatatcagtatgcgcgcatacttagtaaaagtataaaaagccatttgctgcttcatcgaatattttggctttcgttgtacaaagcctcagtccttcttttcctgctgttttcgcctgtattcagaataatctggttggatttcataagcattggggctatatgacctttttttctcaagtttacgatggcgcctttccaatcttctttgtctacgttcgttaaagtcaagatccttctcattctcagattctgaagaagaggatccggaagaagaggatccatcatcatctgaatgatggttgcactcttcttcatcctcattttgtggatgaaaaatgcagcatatcttggtcttttttttattcatgttttcattgtcaatcacattttcttcccatcttacattgtgccttgtaggcattgcctcctggcttcttggaggatcttgagttgctcgaagctgcaaaactgcgggaacctcttccacactcaccgttcgggaccctacggtctgttgttgttctgatcccatagccatttgatttccactcatccttatagacttaattgaagacttagctcgcaactcctggcagttataagctcttgggacccttgactcgaattgtttctaaatgataaatacggccccttgtttatactgaaacgcacgtcgctgatgatttcggacctccaaggtggcaaattctcaagaaaagcctttaagctaagaaacggtttatgactagtaataatattgagaaagaaaagttgcaggtgataacacaattaagaggacttaacaagaaagacgagacataatggaacgactacagagattgatgatgaatagtaaggtggggtccgcggacaccggccgtgacgatacgaaagaaactgtttatatttcttcgattgcgcttttaaagatgctaaagcatggtagagctggtgttcccatggaagtcatggggttgatgttaggtgagtttgtcgatgattatacggttaacgttgtggacgtgtttgcgatgcctcaatcgggtaccggagtttctgttgaggctgtcgatgatgttttccaagcgaagatgatggacatgttaaaacaaacgggcagagaccaaatggtcgttggctggtaccactctcatccagggtttggctgttggctatcttctgttgatgttaatactcaaaaatcttttgaacaactaaacagcagagctgttgctgtcgttgttgaccctattcaatccgttaagggaaaagttgtcatcgatgcttttagattgattgacacgggcgcattgataaataacttagagcctagacaaacaacctccaacacaggcttattgaacaaggccaacattcaagccttaattcacggtctgaatagacactactattctttaaatattgattatcataaaaccgcgaaggaaaccaaaatgttaatgaacttacataaagaacagtggcaatcaggtcttaagatgtacgattatgaagaaaaagaagaatcaaatttggctgctacaaagagtatggttaagatagccgaacagtactctaagagaatagaagaggaaaaggaattaaccgaagaagaacttaagacaagatacgttggtaggcaagatccaaagaagcacctttccgaaacagcagatgagacactagagaacaatattgtttctgtgctgacggcgggtgttaattcagtggcaattaaataaacaaattttataaagtcattatgcattaaataactagaaagccaactacatatatattatattgtatttttttaaaaattctaatgaagtagttagtggaatgaatgggaaagagaaaacgcgttaggagggaaaaggctccttaaataacagtaaaaatgaaatggctactggtagtcccagtgccaatttttttttttactttcttttctttcactcttgcttttcccatacttgtataaacgtttccttcagaaataaaagctcggcttctctctctgtcgtatttatgccatctatttctatccatttttcacttttgttatcatatagctgagtaatccaatggcttttttcatcaccattaaatgcgtttccatctgtggatggttgtttaatgaccacatggaccacatttgcttttaagcgatacttgacgtgcaaaatttcaagttcactggaaaattccaccaacgtttggtttctattcttgacaggatgatcactgttacggtcaaacctattgaaatgaaatattaaaaactgcggtaatcgcgttagttcaaaaacggtgctagtagaggagcttcttgacttagtaaatttagtcaataatttagtgatatttatttgtgggagatcatcaacgctgttgccatcttcaaagggtgaaaattccggcaaatcgagagtcagaacccaaaatggtttgacaatgactttgcctgtaacagactcactggcctcaggcttactttcaacttttgctatctttactttgcctttacaagaatggtttaaaattgactttaattcgttcgaggacgagcaaattttattgaatagccacaaaaggaagagacgtgggtctataggatttaaatttaaaccttctctaactttcaaataggatacaaaatcgtcaacggaaagatgatgtttgaatagtttaggggaccaaattttctttacacatatggataaccttttgataaattccccttgattatcaaaatgattcaataggaagtggtcccgcactggaaccatgtgcgatatcaaaagcaatacactatgcgcatagtcataagttgccgcattggtgaaccctataaatccattcagatatgtgcgattgctcaaatcaaaacactgtctcggaaaatcttctagatcttttggacaataagtcggataagctgcaaattttatgctgttcaacaattgaacctcaccgtcatgtaaaatttggacattttgcggcaacatgtaaaacttcaaacttgtcaaattcaagaagacgtgatggttttcatcaattgaatgtatgaaagcaggactcttttcatgtctcccctgataataatgtccacacacgaggcaacaatatacattcaaaggggatagagtaatgcagcaaattttctcagaatcgaaatctagtttttctcttactacagtctcaagataggcatagtttggttcctgagactttatcttttttactgcctcctgttttaactcatcttctgaatgtctccttttgttatcaacctccattataaacagcgctttaggttaacgcccactaaatgatgaaccatgaagagcatggttagattgctgccaattttttttcctatttcgtcatttttttatcaagattttccagttttttttttttggcattgcttactatacgcgagggaggttcaattgacactttccgctacggcgattcttcagaaactgtgtcatcttttttccaggtcgagctgtaggaatacctgggaaatataggtatatacctgatctgttgttggagtgatgtgccttgaaccaatctctcttgttgttttcggatccctggtgtttttctttggcttggtgaagtatttcagacgtggagaacggcaaagaacaagaggaattttacagccagagtacaaagataagtattattacagtaaagaaaaaggggaagaaatgggcgaggtagcaaacgtaaatgaaattccggtcaagataagaaatcataagtatcctgcgaaagaacataacttgagggttaaagatttgttgttaaatcgcaatccgaagctatcaaagatatccacagcattttttattgctggtgaagaattagagggaaacaagtattgtgacaccaacaaagattttagacagaatagatatttttatcatttgtcaggtgttgatatacctgcttcggcgatattgtttaactgtagcacagataagctgacattgtttttgccaaacatcgatgaagaagatgtcatatggagcggtatgcctttgagtttggatgaagcaatgagagtgtttgacattgatgaggtcttgtacatatctgatctggggaaaaaatttaaagaattgcaagacttcgctatctttacaaccgatttggacaatgttcatgacgagaatattgcaaggtcactaattgcttcagaccctaacttcttttatgctatggatgaaactagagcaattaaggattggtatgaaattgaaagcatcagaaaagcttgtcagatttcagacaagagccatttggccgttatgtccgcgttgcccatcgaattgaacgagttacaaatacaagctgaatttgaataccatgcaacccgtcaaggtggtcgttctttgggctatgaccccatttgttgttctggaccggcatgtggcactttacattacgtcaagaattcagaagatatcaaaggtaaacattccatcttaattgatgcaggtgcagaatggagacaatatacaagtgatatcaccagatgtttcccaacttcaggcaagtttactgcggaacatcgtgaagtttacgaaactgttcttgacatgcaaaaccaagcgatggaaaggattaaacctggtgctaaatgggacgatttacatgcactgacacacaaggttcttattaaacatttcttaagtatgggtattttcaagaaagagttttctgaggacgaaatctttaaaagaagagcttcttgcgctttttatccccatggactagggcatatgttggggcttgatgtacacgacgttggtggtaacccaaactatgacgacccagatccaatgtttagatatttaagaatccgccgtcctttgaaagaaaatatggttatcactaatgaaccaggttgctactttaatcaatttttgatcaaagaatttttggaaaagcaccccgaaagattggaagttgtcgatatgagcgtattgaaaagatacatgtatgtcggtggtgttagaattgaagatgatatccttgttaccaaagatggttacgagaacttaactggtattacttctgaccctgatgaaattgaaaaaatcgttcaaaaaggtttgaagaaaccccgttcaggtttccacgtaatcgtttaggtattaactttttttactcgcttctagaagtttagtatattcttttgtacacagaattgtattttttttataatcttcttggattcaccatttaactagatttggaaatataaggaatggcactgaaaaaaataaggaccaacctacgaagagcaaaaaataaatgcgaattctgtggatcgaacacaggacctccagataacttgaccgaagttttttcttcagtctggcgctctcccaactgagctaaatccgcttctattcatgaaaaatctctgttacagaaactataggactataataactagctgctaacaccttcaaatgcgacttctctcataaggaaatctagcgattcagaattcgagaattttgcagattgcaaagttttctttttaccataatatttgagaatgttgtaaaacttgagataattattcggatgtcattgttgattgaagatagcattcctatgagtcgccctcgaggacttggatcgaaaattctacataatattaataattactattattgttggaattggataaaccgtcgtccacctatttgagaaataggtaattattgtatgagttatgtggttcctttttgttaaagtaataatttgaaatgccatccatttggtaatattcatgttattggcatattatcatatgcggttcaggaagatgacataaaagttgagaaacagttatcaaccctaatggaagctgaaatgcaagattgataatgtagtagcataaagaaacatataaaacggaatgaggaataatcgtaatattattatgtagaactaccgattccattttgaggattcctacatcctcgaggagacttctagcatattctgtgtacataatattatggtcttgatcaacaatgcaatcccaacagttatcaaattattcagaaaattgatcacattttcgataaatctattatgagggtaaaattttgactcatacctaagttctcgttattctttaatcttatgaactcatcaaccttggcgtttcagcgttcgctatgattactagtgcttaaaccttgttattcatgcctcataatttatgccatcttctagcctcgagcgtgataaaatttttgtaatatgaacaccaatcggcggaagatcatcccaaagccacatatgatggtgccttataacattaataacaacttcaactgctgcataccgataatatcttgacgattatgcattcgtgtcctgatagctaatgccatgaaacaattcttttcaatcgcacttgcaccttcgtgaaatagaagggttatctgggcttatcagacttgtccacagtttacatataattttttttctgtattaaattttgtgagctttctttttactccaacgaactgtgttatttttcgttcattaaatgcgtacctttaagcatcatcaagtattgctcttcgggaaaaatgaagtaaccttgttaggttaatttcactagtactatacatattttttcctgtatcataccagaggatcattctagccacaatggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaatgaggtagctgaaatgattgaaaatcaggggctgtttaaagatcatgttgaggatgttaatttccaaccagtcaagtactcagcccttacatcaaataatgaagaatgtaccgcagtagttgccagaggtggtactgcgaatgccataagaatcgcagcagttgataatccagtcaatgttaacaagttggtccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacgtcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctgctgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactagaaggttaggcggaaccttgtatatatttttgtaaaatcgaactgaatacagataattaaggcgcgcaagcaaaaacggcattctttatgaactctgcagaggtgccctttattatttacgacatatatgggaagtaatacatattgattctacaagaagttcaagccaaggtttagatatgagtgaccaaatcaacgttttgtcaatgcaacaacaacaacagcagcagcagcagcagcaagtctatatgtctcctcaagcagaaaacttgaatcatatgtacttgttagttaacaagctagtgaaacagttgagggaaaatcaagcagaaaaggcaaaaatactaaggaacatagacatattatccggaagcttaaacaagtatgagacatctgaagaacctcacgataccacggaaaatattgcattatttaatagatttctagaacaaagagggaaagctcctattactgagaaagagcaactaagcaacaatctggatgaaaatgcgaaagatgacgttatgctaggagtgttgaagcgccaaaattcaatgctccggaaaagtttacaggaatccaagcaggtaacccttgaatccatggatttattgtcttactccgaagactctttaaattacattgtcgcccaattaagaggaaacattctaatgcatcataaagagactatcaaattgattaggcagaaatttcagacggagacaattcccctcgaagatgaagagttcaaaatgtatttggaaaatgttaatggtctgcaaaaattgacagatatatctcacacttacagattactactgaggttacatgcacaagattgaaactttgcccttttgcttccaatgaaagcaagatgacaaatatacatgcatcttatattctagattgcgcaaaaattcgaagctcatttatgaaggctttttccattctgatatatgtttatgaaattgaaaaagtaacgacggtggaacattttgcgggaaaacaactcacagaatgtcttgacgttcttttcctgcagttgcgtgcgtaagatatcctaagctactgtattatctgccaaaaataataaaatgttggaaggaaagcctctataaatacacaggatatatatgtttaatagacatatataatttcctcaatatttgcaaagcattttgttgtgatgagagtcgattatcgtttgccgattagtatctatactattaatatattttcatataattagtataatctcatatacgctgccagaagataacatgaaaattaagaaacaatcatcagcttcaatggaagttgaagtgcaaggataaataatactatttagaaatatggatttttcctcgttgactagaagatctgtgaagattgggtgaatagtttaatagttattggatcccattattgatcaaggctataatacttgactatttggcgaattttgagataattgttgggattccattgttgataaaggccataatattatgtatacaggatatactagaagttctcctcgatgatataggaatcctcgaaatggaatctatatttctacatactaatattacgattattcctcattcccttttatatgtttcattatcctattgcattatcaatccttgcatttcagcttcctctaacttcgatgacagcttctcataacttaagtcatcatctttataccgtatatgataatatattgataatataactattagttgatagacgatagtggatttttattccaacacactaattatcattcgttacatctcaaattggttagagaggttacaaacattattattgatttatccaaggatagttttcacaagaaaacaagcgcaagtggtttagtggtaaaatccaacgttgccatcgttgggcccccggttcgattccgggcttgcgcagtttcttttttttctgatttttatttttttgttcctgaaaatttttcgtattattagatctagtagaaaatgaaagacatttgaaaagagaaatatatattctgcagtaagctagctaagactagtcgttttgaagcgctaaaacgttaacttcgattcatagcacaaaaggtaaataacttttttgaaatggcaagcatcggttcgcaagtgagaaaagctgcttctagtattgaccctatcgtcacggattacgcagtgggctactttaaccacttgtccggaataacttttgatgctgttcaaagtaagcaagtagatttgtccactgaagtgcaatttgtgtccgatttattgattgatgcgggtgcgtcaaaggctaaagttaaagaactatcggaaagtattttgaagcaattgactactcaactaaaggagaacgaagccaaattggaattgaccggtgatacatccaagagattacttgatattaatgtcttaaagagtcataacagtaaatccgatatcaacgtctcattaagcatgctgggtgtgaacggtgacatcgaacatgctggtagaaagatggaaacaagagttgatttgaaaaaactggccaaggctgaacaaaagatcgcaaagaaagtcgccaagagaaataacaaatttgttaaatacgaggcttctaaattgatcaatgaccaaaaggaggaggattacgattctttctttttgcaaatcaaccctttagaattcggttcatccgctggtaaatccaaggatatccatattgacactttcgacttgtacgttggtgacggtcaaagaattttgtccaacgcccaattgactctaagttttggtcacagatatggtcttgtgggccaaaatggtattggtaaatctactttgttaagggctctatctagaagagagctgaacgtccccaaacatgtttcgattttacacgtggaacaagagttaagaggtgatgatacaaaggctttacaaagtgtgctggatgcagacgtttggagaaaacaactattaagtgaagaagccaagatcaatgaaagattaaaggaaatggatgtattaagacaggaattcgaagaagacagtttagaagttaaaaaattggacaatgagagagaagacttggataaccatttgatacagatttctgacaaattagtcgatatggaatctgacaaggctgaagctagggcagcatcaatcttatatggtttggggttcagtacggaggcacagcaacaacccactaattccttttccggtggttggagaatgagattgtccttggcaagagccttattctgtcaaccagatcttttgctgttagatgaaccttccaatatgttggatgtgccatccatcgcttatttagcagagtatttgaaaacatatccaaatacagttttgacagtttctcacgaccgtgcattcttgaatgaagtggctacagatatcatttatcaacacaacgaaagactagactattacagaggccaagatttcgataccttttacaccacaaaggaggaacgtagaaagaatgctcaacgtgagtatgataaccaaatggtttacagaaagcacttgcaagagtttattgacaaatacagatacaatgctgctaaatcacaggaagctcaatcaagaattaagaaattggaaaaattgcccgttttggagccacctgaacaagacaaaaccattgatttcaaattccctgaatgtgataaattgtctccaccaattattcaattgcaagacgtttcctttggttatgatgaaaacaacctattattgaaagatgttaacctggacgttcaaatggattccagaattgcccttgtaggtgccaatggttgtggtaagactacactgttgaagattatgatggagcagttaagaccactaaaaggctttgtatcaagaaacccaagattacgtataggctacttcactcaacatcatgtggattctatggatttgaccacgtctgcagtggactggatgtccaaatccttcccaggtaaaactgatgaagagtatagacgtcatctaggttcatttggtatcactggtaccctgggtctacaaaagatgcaattattatccggtggtcaaaaatctcgtgtagcattcgctgcattgtgtttaaataatccacacattttggttctggatgaaccttctaaccatttggataccactggtctagacgctttggtggaagccttgaaaaatttcaacggtggtgtcttaatggtttcccatgatatctctgttattgactctgtttgtaaagagatttgggtttcagagcaaggtactgtcaagaggttcgaaggtacaatttacgactatagagattacatcttgcagtctgctgatgctgcaggtgtggttaaaaagcattgattatttaggaagcacctcagaatatattttccatagaagcctaaattaagtatgcattcatagccccatgatactttttttttttgactacttgtattggaatctaattgacctaactgggcattctgggtcattgttatatgtatcactttttacgtaaaaaagtagtggctaatataaaacataaaatctacaagaagggtgaagtgcttttcgaattttgccactgcaagtaattggtgcaattgaaatacgagatttcgttctctaagaggatataaaaataaggagattagccctacctatccttgtgttaaaatatgagcggagaaacgtttgagttcaatattagacattctggtaaagtttacccaataacactttccactgatgctacttcagcagatttgaaaagcaaagcagaggaattgacccaagtcccaagtgcccgccaaaaatacatggttaaaggtggcttgtctggcgaagagtccattaaaatatatcccttaatcaagccaggatcgacagtaatgctattggggactccagatgctaacctgatttctaaaccagccaaaaagaataatttcattgaagaccttgcgcctgagcaacaagtccaacaatttgctcaattgcctgttggtttcaagaatatgggcaacacctgttatctgaatgctaccctacaggctttatacagagtgaacgatttaagggatatgattcttaattataacccttctcaaggtgtgtctaacagtggtgcacaagatgaagagattcacaaacaaatcgttattgaaatgaagcgttgttttgaaaatttacagaataaaagtttcaagagtgttttgccaattgtgttattaaacacgctaagaaagtgttatccacaatttgctgaacgtgattcacaaggtgggttctataaacagcaagacgctgaggagttgtttacacaactattccatagtatgagtattgtttttggtgacaaattttccgaagatttcaggattcaatttaaaactaccatcaaagacacagctaatgataacgatattactgttaaagaaaatgaaagcgattctaaattacaatgtcatatttctggtactacaaattttatgagaaatgggctcctggaaggtttgaatgagaaaattgaaaaaagatcagacttgactggcgccaattccatctatagcgtcgaaaagaaaatatcaagattaccaaagtttttaactgttcagtacgttagatttttctggaaaaggtcaaccaacaaaaaatctaaaatattgcgtaaggtcgttttcccatttcaattagatgttgcagacatgcttaccccagaatacgcagcagagaaggtaaaagttcgtgacgaactgagaaaagttgaaaaggagaaaaatgaaaaggaaagagagatcaaaaggcgtaaatttgacccatcatccagtgaaaatgtcatgacaccaagagaacaatatgagacacaagtggctcttaacgaaagtgaaaaagatcaatggctcgaagagtataagaaacattttcccccaaacttggaaaaaggtgaaaacccatcttgtgtttataacttgatcggtgtcattacacatcaaggtgccaattctgagtctggacactatcaagctttcataagggacgaactggacgaaaataaatggtacaaatttaatgatgataaagttagcgttgttgaaaaggaaaaaattgaatctttagccggtgggggcgaaagtgatagtgcactgatcttaatgtataaaggatttggtctgtaagtccatttttcattttttcaaaattaatagttttttcggaatatacatatacatttttttacatacacataaaaatatttctctcccttttacgttcatccgccaatcgataaaaatgcattttatatacatgaaatggcgaattctttttggtcgagtttatgtatactttttcttattcaacccataacgagcttcttgaattcttccatctcttcgtaacaattcaatggcttgcccttattggccaaaagacactcagtcaattttgcctttatagaaatgctgccgttgtcggtttttttatcagatttacctttggcacccccatatttctccaacttttgtaactctaattgatcaaataatgttagtttcttgttcaacgactcgatttgattattcaatgaacttgatgatattccatcaacggcatccttgtcgtcgtctgataatagtgaattgttcaaggtatcttcaaacttctttaacgtttcaacttctaggttagatagcctttgtgaaaccttcttctcaatgaacttttctgcattttgcttggtgacatagtctgattccttcgatgaatccaattgagaaaccaaagactgtgaaaaatcgatctgtgttagcggagtatagacttgttgtttttctgcaccagcacccactttggaagtgtttgaacccatgattgactctgtattagtcgatataccaccttgtttttgttcttgaatttttttttgatcagcaatctctttgaaatgttcctcctcacttgttttttcctctgcgtctcattggaagaagaaatatatatatatgcgacatatcacgaatgttcgtagttttttacaacaaaaacgactctcggtagccaagttggtttaaggcgcaagactgtaatttaccactacgaaatcttgagatcgggcgttcgactcgcccccgggagatatttttttaaatcttgcagctttcaatatttaaatataagtaataaaccatcagttaaacaacagagcaagtatttcttaaatctcatgaaaaatctaataatgttatttgccgaattttattattgatttggttggtcttcttgataattctgtgggcgctttttttgtgacatattaaaattgcgaaattgcaaacgaaaatataaatatatatgaatgttaataaataaattatttaattgatgatcgaggatgaaatacacttttatgatctgtccttacgcgtaataattacaagaaggtgagaaaattgcctttttttgctaattttttttttttggtaccatattcaataattgatgctaaattataaattgattttattgttttcctctttcctacaattaatctctttttctggctttatgatatgttgtttaacttcaccaataattagaaactgggggctggctcaagctgctggagtttcatatggtacctttggttactgtaaaactttgaattctttttcctgctctcgagtacgtttaatatataacacctcgaaagaaaaactacctggcccttttcttaaacgttggtggctgagtcctaaggcaagacatacaataggaggacttttgatttcgataccggttgctacatgtttgactttcatttcttttgcccttcccttggttattatttttctctttcagactggaggaactaatgtctcacttattacttccaacgctatattacacatattgacacttttatcaactatttttgcatgcaccgtgatcctgttacaatttcatccttatacgacttggtgtggctggctaactcttccctgttccctctgctcgttattggcgtgcattttctcagttttaggtttgatacgtctgcgcagtcagacagaaaacatagctaaagaagctagtatagagaacgtagacagtattctcaaactatatggaacgagtcaaacatcaagttcccttggcgaaaattatccacaaacaactaagggcacagaccaatctgtgtatgacatcacaagtctttttaatgatctaccaaggaccttagatcccaatcaagataaactggcggtaacaaatcaagatgaaccaccgcctgaaatcaaatctccattgaaacaggcaggtttggtgagtttcttcgctccaaagttgaatggtaaacaaatattttctagaaggcatgttgaaaatcaaaaatccttatctttggatgaaatcaatataaccgacttacctgcaaagcaagaaaatgtggaaatgcctactgaaaaaaaaatggcaaatattttatattatgaggaaatctcaagccattcacaagataactacgatcctccttggttatttggcgttgaggctacccaatcagccgattgctttaaaatatattcaaaaaaaaatcattgtctcacggagccccgccaatatcaactacaacaaccaaataattaccaggatcaaagtgaggttcctcataactctttcattccttggtattcccgaagaagaccagtaggatacaaccacaattacaatccctactactcacagacaactcatggtaacagcgaacactcccgacaaacattgccacagacctacaacatacacagcatgctccccagaaagtacaagcccgcctacaaaaaacaggcacattgtgtgaagagtaatccacaaccagcttatactttccaatgacaaaataacaagaataaagtattatccaatctgctttttttgtacgcgttttgttggcgcgccgcaatttgaaaaataagagtaaagtacttcttgctactatttaatgattccatccgtattccacatcgttgacgtctgagtctgatagactagtatatagaaaataaaaataagatagagtaaatagtatgctacttttatcgagcccatctttttgagcttaatttctgaaacaaagaaaggaagtgcccatttttcctcttaacggtttccaaaaccactgaagagaaaacaatttttggacataatttatttacattagcattaatagtgacgacaaaggacagatatggcggtatttgttaacattgactttccttatgcgtggaagtactagtaatattccctctcggatcataaaagtgaaatatcgtgcttcacgatttgctgaaactttaacaaattcattgaaattacgtgagtttatactaatgaatggacttaatttcttaagatggtgatatcttccacattggtttcggccaacaaagctatcacttaccaagtacttcaagcaacgcttgcaatcccctattgtttatggattctccatccaattctatccagaatttgcagcaagaagcccagggcagctcttccgcacagcttgctgaccatgatcatgatcgcgtatcaatggctacgcccttacaaaccgatcaaagtgttagtgtttcacaatcttctgataatttaaggagatcaagacgtgttcctaagccaagaacgagcatttatgatgaatacgaggaagagttaaaggaaagggcgaataaacccaagaggaagagacctgctcctcctaagaaaaaggcaccttccacacaaaactctaaatcaaatgataaagtagagaaaaagaagactacctcaattgctaaggatggcaaacctacactgaagactaatgacaaaaaagtggcgccgaaacctaaaccagcccatgaacaagtagaacccgctttgatccctagcaattggacttctgtaatacccttgcttacttctgatttcaagaaccagtatagtgtcatctctaggttaaaaaatccgaacatgaagcctgtgccatatgctggagatatcattaaactgatggcgttcataaataagtttagttcttttttccattctgacctacaaaatttatcattccaagattttgaggtcggtttagatttgtatcccggcgatcctaatggaagcgcagctggtatagtgaagggtcctgaagacacctccttattgctatatcctgattttatggccatcaaggatatcgtctattgccaagacaaaatgaatttactgttcctatccttgttagatttaacatttactgaaaattttgatggtaaaagtgccaagaagaaaggtccattaacaacctgggagaatctaaaatcgtcctccaagaaagtattttccaatcctctttatcggttaagacttgtagctcgcgaatgggggtatccacgagaatggcgtcaacaactccccagtgaccaagatatctcgaaacctaaaactgctctttttgaacaagatgaacaaacaccagtggtggatcccagtcatccagaaattttaacgccaaatatatatacctggaatgctaatgaaccactcccattggaatcagatcctttgtataatcgagaaatggacaagaatggaattttggcgctcaaaccaatggatcgcgttgttttattgagggctttaactgactggtgcgcttcccattcatctgctattcatgacgagatatacaaattaactcatggtaaaaaagatcccgtttttggcatccaaacacaacaagtgcctaggtatacaattgaaggggtagataatactataaatcagtttaaaaaactctgctcactaattcaatcaagatatgaaatcagaagtaagaaaaaacattttgttaaacaactaaaagagggtaaaaaaccagatttatcaagaaagctagaaatactgaaggaaattaaagcggaattgaagaacgctgtaaaatccgaaaaggatgaacttttgttctcattgtacgacaagtgggtcccattgtttgaaggcgaattacctgatcaaccattagccaatccttttttggaaagactttataaattgcgattacaagagttcttccttggtagagttccccatataggtgatttttatatgccaagattacacagttatggggactcactcgaaatgagcaccttcactgatttgagaaatctacaagcattgctatcgaaattcaaaaataatgaatacaacgcttttacactgtttgaaaatgatggacaatcgatgagtgcccaattcaaattgttttaccatgacacaccatcgttggcgcatgatgttgcacgaggcagaaatacatcggggaaggtttattggtatgaattatgccacgattcagcaacactgctggagttcttggagttcttggactataaaattgttaaacctcaagatgagaaaaaggagggaaatgaaaaagaaaaagaagcactgaataatgaagcgcacatattggagcagaaatctaccactgataataatccctccataaatacaaacccgctaccaaaagacgcaaaatataacactgcgagaaagaagttacaaatattaaaggaatttttatctgattactatttcattcttcgtcagtttgaacaaatgaaagtgcaatttgcagacatgaagccaggcaagagacagttgagaaggatacagcgacagactgtaaactataatacggaatatgatagcgaggaatatgtcgatgatgaagaagacgacgaagctgatatttatgatgacaacgacaatgattcttcttttgatgatggtagagttaaaaggcagcgcacttagacaactagctttcaacgaacgtgaagattgtgaaactccttacaggctccatttcgattaattaagtaatgtaaaattaagactattagtacataattagatacgcgtatcttttcaactaaggcataaaaaaaaaggtagaaagtgaggacgaaaaagtgcaaaatatcaaagtcaaatcttgcgcatattcgagcttacaaagtcattgaagatttattcgccagtgtggtaaaacggcatactgttatcattcttctgttttggtatccttcccctctggtttctccttcgtctcatccaaagactttttatcactcccagggagatcgctatcagaactacagactctgttaatatttaaaaatttttccttttcggcaagcactgggttaactaattgtgcaaaagctttgctggttaactcggacttcaacttagactgttcttcttctgatagcttcttggatagttgactggtatccgttgctttcaatggaggaactgaaccgtttgcttgacttccttcgtcaaaatctgaatcactctctgtctgttcaagatacagatctcttaatttctggatcttcatgtttaatctgactctctcaacagaattacggaacttttgacgagcatccaatccttcctttaacccaggcaataaattgtgcgtcttcaattcggtacaaataatccatggatcttccaagagttctgcggcggtcggtctctttgaaggatccaaattaagagccttcaagatgaattgttttgctttattggaaacggaatcccaataaggcctatgaaacttcactggatactcaccagttgtgcattcgtcaaggaaatcttgaaccctttcggctctaaacgccgaataaccgcaaagcaaagtatacgtaatgacacctatcgaccaaatgtcgcaaggtttaccatgaccgtcctgagtaagtacctctggagccacgtaacccagtgagcctgccggcttatagaggagttcctcatcacttttcaatctctttgcgataccaaaatcagcaactaccagtggagattcgtcacttttatctatatacaataaattttccggtttcaagtctctatgaacaatattctgagaatgcatatatttgactgcgctcaatatttcaaccaaaattctcactgcatcttcctcagtgaacttacccttcttcaaaattctatcgaacaattcaccccctttggctaattgcgtgataatgtagaacttgtcttttgattcaaaccaatccttaaatgccactatatttggatgatgtagtctttgtaaaatgtctaactcgtcgtataaagcctctagctgaaccttgtttccctttagtgctttcttgatcaggattttaacggccacgtcctcccctgtttcagtgtttttggcttgtctcaccacaccaaatgtaccagcacctaatgtcttcccaaaagcatatttttttttattcacgtacgaagcaggctgcacatgtgccattttaccttcagaatcctcctctgtttgttttggggagctctccttttctgaaactttgtcgtccatagtaattgactcgttattttttctggtgtcttccaatattatataattgtgagttctctacgagaattgaaaccatttatactctggcttgtagtcgatgtggctttcgttctttttatcccctgcgtaggtagctcggctgcaccattctaaacgtggggggagtttctttttttttttcagccttttcttcgtaagcaaagtatcccacgtaaaaggttccttatagtaacatatgtactgtaaaggtaaaattacttctattttttctactgctattatttctatgtacttatacaagaataacagaacgtgcaatactaaaattaatttgatgctcagctaaaagagtaagatatgttagcagaagttaagatggttttaattatcctcgtagtatgcagacgtatcgttgtcatcatcgtcattgtcgatggctccattcgtgctcaaattaaaatagtcatctgcattattagcatcttgaagggtacctaaatcgcccggagtcatgtaaacagtactattggaccttactttgggggatccgggtacactcaaaggcctggcaatcttgaatttcttgccaccggcaagagtgttcatattggcgtcactaattgtttcacccaccaattgcttgaactgctctggataggccctacgaagacctaactgtctagccttaacgtattccaaccccattctcttccaatctaacaagtctgatagtctttcggttctgtttctttggttgattctttgtcttctggtcttgtttacaaactcttccatgtaatctgctaattgctcgacagattcatcaggactcttgaaacgacggtctacaatataaataccatagtctttcgcttggtctgtttcaatcaagtcttccatgtaggcaccgaacccagaaacgtttgttgtgatagatgggacacccatgacggtacattctgctggcgtgtacccccatggttcgtaataggatggaaaaacacccaagtgacagccgcgaacaaactcgtcataatccaaaccaaggatagggttattggcgtttaggaattcaggatggaaaatcacttttacacgatcactcgaatcattgaataatctaacatgtctaatttggtttaaaattggatcgttagcatcatcgcacatgttatgcgtgactaccggaggcagttccccgtaaggtcttctcagcgccaatacccttttcttcagcaaaaccttttcagaactcttcaacagctcatccaaattagtgggcaactctgattctaggccattatgagggtatctcatcgtatgctcgaaaattctcttcccaatggatgcggtgacctcattaacagtattttccaaagattttacaatggcttggcttttcagtgcctccacagtgaaggaattggttttggcaggcatgatcaaaaacgctaccacagtcttcttggatccagaaaccttcaatctgtaattgagacgagccaatgattcaatgaacatgtcagcacctttgtttttgtattcatatctaccagcgataaagaaataaactgtgttgtctagatcgaaatcaaaacaaccatggaaatggcctctgacgaaatcattaattttgtcttttttcagggcatgcagattttgaaattcatgtactgcttgaaacttaacaacgttcaaaccattgggcaagataccatccggtttcctcttcaacaaatgctccgcttctaatgcagtgatttgcgacacagtcgtaaaaacatcggcagtatgagccgcagcgcgctcaatgcagtacctatgatatatgcctctcttaccagcttcttggtccacatcaaaatactgtagattgttataaaaatctacatcaccagcggcacacaagtatctacccaataaagttgcgtgcgtggtgaaaatcgttacaacatcaattcttttctttctacacaatggcagggctacaccagctagccattcatggaaatggccaatgatggcatggctactgtccaattttgaaacttctcccaaaaaccacacaacaacataacccaacaatatggcatcgtttgtttcgtgatcatgctctggtgatggaattccgacgagagaccataggtcagccttccattcgttcaaaaagtgtcttacagaatccagctcaaataaaatgacacgtggtgctccctcaatcaaccagttaccgtagacaaagttcacacccttttcccgcatggacatcaaagttttttggattggtaacagctcttcaggaaagatactttcatcttcccagtcaagtttttcaacctcactttcataagtcgccttgttcaaaggtccaagcagcgtatagttgtctccgtattgtgccacagtgactggggccttggacttcaagacagagtaaataccaccaaccctgttagctacttctgttgctacttcgaacagtagatgattttgtaagtcacgagccatacttcgctgtgatgctgcttctgagtttattttctttttcttcacaggtttccacgctgtgctaactagtatatttggagtttagatatatagatataagtcaatgaaaaaaaaagtggaaggtaacaagaagaaccgttgcgggaagaaaagaaggagtttatgtttatatacaccggtgtaggctgtgcgttggtgtgaacacttcctgttgctgttgctgttgaagccgtctccgcatgcaactgtagtcatacagcctcttgtctgcccttattcaattgaccagctaacaatagcttcgctttctttctgaaaaatcctccaaggggtattacttgtggggggttccaggaacccataggccggggcatggttcacgggaagttctgtggcaggaaatggtccctgagtagccgcgcaggtggcttttgcctttgccgtaccgatcgggaaattgtgcccctgaaagattccgtttacggcgcttctgtgcaacctctttgggcaagctttgctcctgtcaatagagcaattatttgacaaggtttcttttaccttgttttatgtgggttaaacgtgggaggagaactataaatcacatgtgctgtcaagagattatgttagttacatagcgcgcttaagctttcttaaatagtatcgtaaatgagttcccgcaatttgtagtcttcgttagcttcttctatttcttcccagttcccgattaagtcattgtgtcctctgaccacacctggaagactcctacccttgctgaaagtcttccaaacttttctcgcttcatcatctgtgccaagatctctgtaggtgaacgggattcggttggccgtcaggattgtgcttaagcgatttgttctggggatcatatggaaaccgcctccggctagtgacgtgtatatatatacaggttccttttcattcagcttccggatctcgctagtcgttattacgtcttgcggcttgtcattgtttttcttggattgctcagtagtttgagttgtggagtctttcgcatctagtgattggagtagagcgtttagttcggaatcatcaacaatttttagttgctctaaaaactcattcgtttcgtccaaaatatctttgaaaatgtcatctgcacttgctttcttgggattttcccttgtactttgatcttcaaatccattttcgtcattgtttggggcttctttactgattgactctgtttcattgaagtctaactgggatatctcctcttcttcttgcttaatttcattcttttcttgtgtgatgttttcttccaccacaagatcaggaagagaagtttctttctctgtttcttctacttccaattccttgtcttcccctttattatcctttatatcttgtttttccaattctggcaattcaactgtcctttgaaattcgtctgaaatgttgatatcgtcgatctcttgatctccggtgacgtctttgagcgcctcagcaatcttagaattttccatattctcgtcttcttttgtcacggcttccgcatccttttttgaaacttctgcctccgtacatgttccatcctctattggagtctcagcaggttccgaacattttgtctcgatgtcttcttttgaagttgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgacagattcgctgctaggttctatatatttttcggcagttccaacatcacttgcttttgaattttcgctcgcagcctcagtagcttcaccatgttcatgatttgtatctttcccggtgattttatcaccttcttgtgtaatttcaaagcgtttgggtttttcttcttctttgaaactagtagtagatcctacatctcccatatccttttgtgtagtttcagcttgttctgttgaaatttgaacgcgctgggatttgggatcttcttcttcggaattctcaatggttgttgcaatttctggctttacatcttcatcgggaactctaacatcttcctttagaatctcaggatctctttcgtttatttgaagatcttctggtcttccggaggtacaacgcttaactacttttggagactcaggagtcttcgatttctcaacctctacaccttctgtactttctcttgctgtttcatcaacctctttttttgctttctcgttggaaagctcagcagtcccctcttgcttctttttcatgtcttcactaatagactcagcacctcttattgctattttatcatctttcatggccttaacaggttcatccagcttgacttgttccccttcttgatcttctttggcaacctcgagatcttcaggtattatatttttttccacagcctcaacaatctctacatcatccctaggcgcgtcaggtatatcgatttctccgacaacttccgtaggcttgttctcctgagtaggtgcttcagcttcatcttcgagaacaaggttatctttagaaatttttgcagagtttgcgtttccctctatttcaataatggaagatttttctcccgcttctgactgcttttcatctccccccataatttcctttccttttgatgtagattcttcttcggtaccggacacttcattatttcttacagcttcttgctccccggttacattttcttttttaacttttgaaaaagtcgaattttcttcttcttcttcttcttcttcttcttctttttcaacttctacagatatatcgttagtaccgtgttgtagatttttttcattgtcactaatgcgctttgttggtcccatcgtttcgtcatcataagtctctcgctcagtttctggagggatgatactatcactaccagctgcgttaaaattatggctcatgttattctcatgattaatagataattctttcccacatttttcgtcttctttatccttctgttcaaaaacatggtcttctttcccgatttctgtttctttctcattttttgcaagaactgaaggacttattccgtctctatcactttcagtctgctgcttttccccagctttcaaatgttttgattcgttctctttgaaattaaacccattcttagttaaactttcactttcaacatccttagtagacgcttgcccattttcatcacctgcctccaaaccgtgcggctctagttggtgtttaaaagaagctgcatttccctcattaacatttaagatctcattctcttctcgaggtaaggtatgttctgccttttcctcgttgatattgttctcggactttgaggaagtttcgtcaacattatctttgttaggcacatctatgtctaaggtttcgtcactagattcatttctggttccgatatccattttttcgacattaacaggctcatcttggacaatatttactttgatatcctcgttctttgaaccatcttcctgtaggtactcttcaatgcctactagtatggaatctaaagttgactgttttgacaaatcagtagtatctgcaggatttgaagaattacgacttcttctattcgtggtttttttctttttgtttttttttcttctcgtaattgggctattgccaacctcaattcctgtggattctttgattggtggtacattttctgtgccttccgctacattgttagtagaagtttctttgatagctacattgacgtctattgggatctgtgtaggagattctgtagcgtcatttattgtatctgtggctatctctattacgtcgtcttttctttccaaatcatgagagattgcatcccgtgtggaagcttcctcggtttcaccaacagaactggaaagttttacaatagtatctctgtcacgattcgcctttatttgtccctggtttttctttttatgacctttcaatttagaagatttcctttgagatgataactcctgtgcaaaattctcagtggcatttatcgcttcatctaagtcactttctgtaagttgatctctactttctataatatcattcgtacttggtaagggaagatctgtaggaagtgtcgaatacgagtctccagcactagttaccgatgggggttgaacattgtgttcctgattttctatagtcaaagattctaccatgtcactctttatttaatccagagtaatcaagcacaccagtacaataattgctaacaggtttaaaaagagaaagtgttctggaataaaaccacttgcttatatgcgaagtgactacgaaatattaagggaaaatatacgacaatttcgtgttcagaaacttaacaaatattttcatcttgtctgttatattctcggaagctttaggataaatttatcctaaaaaataactgcgcaagcccggaatcgaaccgggggcccaacgatggcaacgttggattttaccactaaaccacttgcgcttatttcttggaagtgttcgtattctaataaggtcacaacagctccaaccttaacccgaaacctgtaaatagccccactacgagacaacaattgtctctgtattcctctctttctcaataagcacttattatttagtttacatccgagttcttgagcactccccacctttttagtaggtctgaagtcttgtttacaacagcgggcacctcaagattgaaaggagttgagagttagaatatataattttgaaattaaatttgaaaatgatgcgattaccaccggcaagtattcaaaacaaaataagacgagagagcttcataaagattagatcgtatannnnnnnnnnnnnnnnnnnnnnnnnnnnnnnnnnnnnnnnnnnnnnnnnnnnnnnnnnngacttcttcattaatactaagttttaacctctaattatcaacatatatgttgaaatgagaggatttagtacattctgtatacatcatattatagcctttaccaacaatgaaactccagtaattatcaaattattctcccaattctcaccgaacatgcggcaacgttaggtacggatcgcggaaaacactttattttgtgcagaggtactgtcatgaatactatgtcaataaaaaaagtatcgcattatcaccacgcctatataacataatctaaactattcgtgagggtacagaaatccattgaaatggattgatagttctacacgatatcgctgtcattttattgtacgtttcaagttttactaaataaaaatgacatctgaaacagattaagtttttttgtaacttgtgcccgttgaaataggaattaactgttataattgacaatattcatgtcaacactatatagtaatatataatgaagaaggtaacttagatggcgataggcggtcaacgaacctagggaatcagaaatgcaagaatgaataacgtaataggatagcgaaggaacatatcaaaaacaagggaaaaacaaaaattggttctatatctagatatatctagaatttttggactcgttttatctcaatttccacctatctttatgtattatctttcgaccgtcttatcttttaatatggcggcaggaataccagtcagacaatgataggatcttgtctcgggttgtttgttatcacgtaagcaccacagtccgctccgtaggaaaagaaaaatagccgccgagccacgggagcaaatgagtgaagaatatgcgcaacgttttggtacatatacaaaaaaatgtagaaaagaagctaaagagattgacgttacgtacatatgtatgagtgggtaggtgtggacgacactagggaggctttacttctctccaaacatgtgaagctggttataaatgtccttcttaaagtcctcgtacttaaaagacgactttctacgcgcgcccaactgtggaggagagccgtgtgggactcttgcgctgttaccattgctgttgttgtcaaggtacgagtttttgaaaatgggtttgttgccagcacgagaacggatcggtgtatgggagatggagtcacccatatccacgccaacgtggctcaggtcagagtcgttagtggtcctgtattgcatattgtggatagtattctggaaatccatgggtccgctactcctacgttcggctcccggggcgtgctccccgatactgctttcgcgttcccgggcttgttccctggaatttagtgcgtccatataattggtagaccgccgtctaatcatggggactggcttgtctacgctttgagcgggagcgcttggacccgggaggttgaatgtagaaacaataggtgtttcctgtgcacagggcggttcgtcgatgttgaggaagtcctgtgatctttcaaatgtgggtgacgtgctcacttggggcgtgttcaagtggggatctgtcatgagggtgagtgtatgcgtgtgtgtgtgcgtgtgtgcgtgtgtgcgtgtgttgcgtagatgtgtgatttgctatgtgttatgtagctgctctcatcgctgctgatagtagatctctcgcgcaaaaattactcaggcaaacctttactatacctacatatatatatatgtatgtatatgtatgtgtgcaagcttttcagagtggtgcactgacattgaccgggccactcattccaccccacatcccccagatcagggggagatgctaacgaaaggaaacaggggatttatcactggttacgggagcgtagtgactgtactacaaattcgcacacaagcagcgcccagtgacgagtctccgcggcgtctaagtgccggaagtcatcatccacggtgtgccatgtacttgggaatggtagcgggattgcatgtaatacgggtactccggcggccaggaatggcgtgtggtcgtctccgatgaccgaatgcccgagccctaaaaatcgatagtccgtggggtccagatgtttgcgttgacgcgcgacttcggcggctaatgccgatttgccgttgatttcatctccacgtcgaaataacaagtcatcctctattcgattgagcagctgatattcttggtgtgtttctgcatagtagctgggcactagcggctcctcttcgccacttcctaaaagatccagaagaaataataggcgaattcttgtcatcgtgccgtcagcaagccattgggcggctaatcggcgtgctccataaatcgagtcctcggggccccactcttcaatggcctcctctccatcaaagaatacgatctttacacccaaggtagaattcgatactacagtgttcgactctaagtcattgtactctgtcgtgcgctcgtggcacgcgatgtgcgttaggaactgggccgtatatagcagcgcggcacacgaggcggcactgtcnnnnnnnnnnnnnngtatcataatgagcagcgagcactaagtactcgctcgcattgttctgtaatgtcataacaaggttattgaagcggtaaccgttctcctcaaaggcttgcgtctcaacggcccattctcccgccagcgtattgttgaagtgctcgatgatgaagcgctggatctcgcgcgagccttccgatccgggtacgcgcgttctgttaaaaggcaacagcaggttcttggtacttttgttccaaccgctgtctaggttgatagcttcgttcagatgcgctgcatggtactgctcatatgacaactcccacccagttaccctatgcacccgaaatagcaccaacaggtacgctagaccaattagtcgcaaaggcaatacgtacttcattcccatgccgacgaccttttgagtctttttatttcttttctgttgactctctctaactcttcctctccccctgtcctttccatgaaatgtatcacaagccgtcttattcctttgcttcttatattcttatgttccttccttcgtctcgcctcgaaggcaacgcaaacgcaatgtacttcttgacgaacgcgaaaaccatatggaaagtaaataaagggccaaacaaaaaactatttcgaatagcaaggtagcttccatcttgcacacgcaagaccgtcacacagcatgtcatcggaagaaccccatgcatctatatcctttccagatggctcacatgtccggtcgtcctccactggtacttcatctgtgaacacaatcgatgctaccttatccagaccgaactatattaagaaaccgtccctgcacattatgtcgacatctacgacgtcgactacgacggatctagtgacaaacccaattctgagcaatatctccgtgccaaaaataagcccccccacatcatcctcgatagcaacagcgacatcaacaagtcacgtgaccggcactgcgtcgcattcgaatattaaagctaatgctaacactagtaccagcgtgaataagaaaaatttgccgccaacaacaagtgggaggataccctctaacaccatcaagagatatccgagtcgctataagccttctcactcgctgcagctgcccattaagaacgactccaactttaaacgatctagcatatatgcctccaaatccactgttactgctatccccattaggaacaatcggccaatttccatgcagaattcctatgcgcgcactcctgacagcgatcatgacgacgttggcgatgaagtgtcttcgataaagagtgcctcttcttcgttgaccgcatccctgtccaagagtttcctgttcgcattttataacaaccgcaagaaggacaagaccagtaacaatggtgtcctctcaaaggaatattggatgaaggacgagagttctaaagaatgtttcagttgtggtaaaacgtttaacactttcagaaggaaacaccactgcaggatatgcggccaaattttttgcagcagttgcactctcttgatagatggtgatcgattcggctgtcatgccaagatgcgagtatgttacaattgttatgagcatgcagacacatacgaggactccagtgatgaggagaatgattctacaatgcaattgaatgagccaaggtctcgctctcgctctcgttcttccaataccaatccatatgctcattcacattcgcatttgcatctcatttcacaggacaaccataacggtaccgatctccatgatccagtagcagcaacggataaccctcaacagcagaatgaggtctacctattaaatgacgatgacgtacaaagtataatgacctcaggtgaagattctaaattgttcatttctacacccccaccaccaccgaagatggccatcccagcaacaaagcaaggcggatcgctggaaatctcattcgattcggaaaacgatagggctttgcattatcaagatgacaaccccggtcgccatcatcacctcgattccgtgcccacaaggtacactatcagagatatggacaatatatcacattacgataccaactctaattccactttgaggccacattataacaccaataacagcactattaccatcaacaacctcaacaacactacttccaacaacagcaactataacaataccaatagcaacagcaacatcaataatcctgcgcattccttaagaaggtctattttccattatgtaagcagcaatagtgttaacaaggacagtaacaatagctctgcaacacccgcttcgtctgcacaatcttcttccatactggatcctgccaatcgtattatcgggaattatgcacatagaaattacaagtttaaattcaactacaattccaaaggtccttcgcaacaaaatgacacggcaaatggaaataatgataataataataataataataacagtgccagcggtattgctgacaacaataacattccctcaaacgacaatgggacgacgttcactctagataagaagaaaagaaacccactgacaaaatctaaatctacgtccgcttacctagaatatcctctaaacgaggaagactcttctgaggacgaaggctccatgtccatatattctgtattgaatgatgaccataaaactgataatccaattagatcaatgaggaactccacaaaatcttttcaacgagcgcaagcttcactacagcggatgaggtttagaaggaaaagtaaaagcaagcattttcccaacaactcgaaaagttccatttatagagacttaaatttcttgaccaatagtactcccaatttactttctgtagtaagcgacgataatctatacgacgattcttctcctttgcaagacaaggcctcttcatccgctgcaagcagactcactgacaggaaattcagtaatagcagtggcagcaataataatagcaatagtaatagcaatatcaacaccgatccttggaagagaatcgctagtatatcgggattcaaactgaaaaaggaaaaaaagagagaattaaatgaagtctctcttttacatatgcatgccctattaaaacaattattgaatgatcaagaaatttccaatcctcaagaatggataacccttctagatggcgctttgcgtaaagttttaaggaccatcctgaacgcgagggatttgaacaccttagattttagacaaacttacgttaagataaaaagaattagtggtggatctcctcaaaattcagaatatatcgacggggttgtcttttcgaaagcattgccgtcgaaaacaatgccacggcatttgaaaaacccaaggatactattaatcatgtttccactggagtatcaaaaaaacaataaccactttctaagtatagagtccgtctttaggcaagagcgcgaatatttggataaacttgtttcgagattaaagtcattacatcctgatattatatacgtcggcgccaatgttagtgggtacgcgttagaactattaaatgactcaggcattgtcgtacagtttaatatgaaaccacaagtcattgaaagaattgccaagctaacagaagcagatattgccatttctgtggataagttggctacgaatattaagatgggtgaatgtgaaacttttgaagttaaaagctacatttatggaaacatcagtaaaacatatacatttcttcggggctgtaacccagaacttggtggaacaattttgttaagaggtgatagtcttgaaaacttgagaaaaatcaaacaagtctctgaatttatggtctacgcaattttttcattgaagttggaaagttcattttttaacgataatttcatacaactttctacagatgtttatttgaagagagctgaatccaaaaaactgcaagttttcgaaggttattttgcagatttcttgatcaaattcaataacagaattttgactgtatcaccaacggtagatttccccattccctttttattggaaaaagccagaggcttggaaaagaagctcatagaaaggatcaatcaatatgaaagcgaatctgatttagatcggcaaacgcaactaaatatgcttcaaggcttagaatcgactatcactaagaaacatttaggaaatttaataaaattcctgcatgaaatggaaattgaaaatttagagcttgagtttcagaagagaagtcgtcaatgggaggtttcatattcatcatcacagaacttacttggtacgggctcacaccagtctataacagttctctactcaatggtttcaacaaagactgccacaccttgcgttggccctcaaattgttactattgactatttttgggacagtgatatttccattggtcagtttatcgagaatgtcgtgggaactgccaggtatccctgccaacaaggctgtaatggtctgtatttggatcattatagaagctatgttcatgggtcaggaaaagtagacgttttaatcgaaaaattccaaactagattaccaaaattaaaaaatattatcctcacgtggagttattgtaaaaaatgtgggacatctactccgattttacaaattagcgaaaaaacctggaattattcgttcggtaaatatttagaagtcatgttttggagttacaaagatagcgtgacaggaattgggaaatgtcctcatgatttcactaaagatcatgtcaaatactttggttacaatgatttagtggttcgactagaatattctgatttagaagttcatgaattgataaccccaccacgcaaaataaaatggaaacctcatatcgacatcaaactgaaggtggaactatactataagattctggaaaagatcaataatttctatgggagtgtcctaagtcgattggaacgtattaaattggatagtatgactaaagataaagttcttagtggacaagctaaaattatcgaattgaagagcaatgctacagaggagcaaaaattaatgttgcaagacctggatactttttacgcagatagtccttgcgatcaacatttaccattgaacctggttatcaaatctctatacgataaggctgtaaattggaactctacatttgcgatatttgcaaaaagctatttgccttctgaaactgatattagtcgtatcacggccaagcagctgaaaaaactgttttacgattcttcaagaaaagacagcgaagacaaaaaatcacttcatgatgaaaaggcgaagacgagaaaaccagaaaagaacgaattaccgttagagggattgaaagatgtcgaaaagccgaaaattgatagcaagaatacgacagagaatcgtgacataacgaacgaaccacagaatgccgtgacgataaccacttttaaagacgacactccaattattccaacaagtggtactagtcacttgacagttacaccttctgcatcgtcggtttcttcttctttgacccctcaaaccgaagaacgtccgccaataagcagaagtggaacaggtatatctaggactcatgataaaagcactagacctaacataagaaaaatgagtagtgatagtagtttatgtggactagcatcacttgctaatgaatatagtaaaaataataaggtgagtaagctagctacatttttcgatcaaatgcattttgatgccctgtcgaaagaatttgaactggaacgtgaaagggaaagattacaacttaataaggataaataccaagccatacgattacaaacatccacaccaattgtggaaatttataaaaatgtcaaagacgcagttgatgaaccgcttcactctagaagttcaggcaataatttgtcatctgcgaatgttaagactttggaggcacctgtgggagaacattcccgggccaataattgtaatcctcctaatttagatcaaaacttggaaactgaattagaaaattccattagccaatggggagaaaacattttgaacccctctggaaagaccaccgcaagtactcatttaacttctaagccagtagtaaaagaaacttcagaaaatccaaagtcaatagttagagaatcagataattcaaagtcggagccgcttccacctgtaataacaacaacaactgtcaataaggtagaatccactccacaacctgaaaaatcattattgatgaaaaccttgagcaacttttgggcagatcgatctgcgtatttgtggaaaccccttgtttatccaacctgtccttcggaacacatttttactgatagtgacgttataatccgcgaagatgaaccaagttccttgatcgcattttgcttgagtacttctgactatagaaataaaatgataaacttgaattcccagcaacaacagcagcagcagcaaacagcagaagctgctcctgccaaaacaggaggaaacagtggaggaactacgcaaaccggggatccctctgtcaacatttctccctcagtttctacaacttctcataataaggggagggactcagaaatttcatccttagtaaccaccaaagagggcttgttgaacacccctcccattgaaggcgcccgagataggaccccacaagaatcacaaacgcattcccaagcaaatttagatactcttcaagaattagagaaaattatgacaaaaaaaacagccacacacttgagatatcaatttgaggagggtttaacggtaatgtcatgtaaaattttcttcacagaacattttgacgtgtttagaaagatttgtgattgtcaagaaaacttcattcaaagtttgtcaagatgtgttaaatgggattccaatggggggaaaagtgggagcgggtttttaaagactttggatgatagatttattataaaggagctgtcacacgcagaactggaagccttcataaaatttgcaccaagttattttgaatacatggcacaagcaatgttccatgatttgcccacgactttggctaaagtatttgggttttatcaaattcaagtaaaaagctctatttcaagttccaaaagttataaaatggatgttatcattatggagaacttattttatgagaagaaaacaacaagaatatttgatttgaagggttccatgagaaatagacatgtcgaacaaacaggtaaagctaatgaagtgttgttggatgaaaatatggtagagtatatttacgaatcacctattcatgttcgcgaatatgacaagaaacttttaagagcttctgtttggaacgacacattatttttggccaaaatgaatgtgatggattattccttagtcattggtattgacaatgaagggtatactttgacagtaggaatcattgatttcattcgaacgtttacatgggacaaaaaattagaaagttgggtcaaagagaaaggcctagtagggggggccagtgtgatcaagcagcctaccgttgttacaccaagacaatataaaaaacgttttagggaagcaatggagaggtatattttgatggttcctgatccgtggtatagggaaggaaattaatacataaacgtgtacaagttatattctgtaacttttttttatacactatcacgcacattagtgttctttatctttcagtaccttagtagttatcaactataaaaaggtggttcaatgaatgttacgaaaggtttatagaaggataagaagcaaaaatttaaaagagaaatgcgtcacagacaggattcgaacctgcgcaggtaaaacccaatgcctaattgcttttctgaggaaatagcagggcatcgccttaaccactcggccactgggacagaatctcttggtttgttcgttgaagtaaactattttgttgcaaacataatgggtatgtttaacggcgagagaaaactatgcgaaatttggtataattgttgtgtttccattgttgttaaaggcattaacactaagtttacagaacatactagaagttgttttcggcaacataggaatctacaaaaggggatggataattctacataataatattattatttcccctttcatttttgacataatgtcataaattcgtactctatgttgctgatgtgcttatgaacgctacaaccaattttctcatgcatacttgaggtaataagatgtcgacacttttatggtgtttatgaacatggcaatacccgttaccactcgtgttgggtgtaggtacagcaacactagattccgaatcacccccgtcattgccaccatactactgtagcgatatggcgagtgtgtatcattgttgttttgtcgttggccatcttcaatataatcaatatgaaagccaatcatgcattttgaaaagatagtctcgcggtcggtgttgaggaacttttcattgcctacgtcgaaatcaaattttgaaaagctgtggctagagttaaacctaaaacagtcattactattcgaaaaatttgacgcttacgttcaggttctgaattaatcccttccctctacacttaagtttggttgtggtttatgttaatactacatcgctcggttgcaaacagacgtgtatagcttttaggaatactgttgttcaagatagagcatttgcataccttatcgaggttcactatcgctgctacattggcataaaattgaatcgttaaggacggccaatactatacttgctgccacattggtttaattcgttcactatgattatggttgcaacagggcagtttctatcgtggtcattcgccacatactaaaaaagataaaagaagttaaacgactagactaggagttatgcagtatgagctgcagctccgcaactacaactagattaaatactgggggggcaagaagataaagtgagtatcttgagcaggagttcccttgacatattaatctgtaaatttgtttttttactgaatttactacttaatagcaaagatgtggtgctattctcactttttattaatttttgtttccttcgtgacttcttttgcacataagctcccagctaataactcaacgactaatggaggtaccgacggaatagctgtcccagttatagaaactactattgattcagggatgtattctgagaacggtactgatttgatgacacccgaagatcttcctgatttgctgtcagatggtatagtattatcttttgctaatactacagaaacgggctcggattcggactccacgttaattgacagtgaagatcttcagagatgtatagatataccggaccgctcatgctctgctcaacgaggcaatttgtgttcatacagtttttgggatattcctttcagtttcttgaatacagtccatgatatattcggcatgactaatatgggtaattgcgcagttatggctggtaataagggtgctttttattataaatactatcctgttgaacctaactgcaattcaactatacaccaaaagacgattgacgatgctttacaacaagcaattaaacaactgaatggtgactttaacaacatatattttttctatgtcaaccgtggtggattgtggcagggtggtatgatggttggaactcgcgtctttacctggtttgctggcgccaagtgggctgaacataaaggttccatagaggcaggtttcacctcgtagtccctcattgcaggaagagaaggcatagcaacacagtatgataaagcaatgcatttggtttataattgttaataaaaaaaaaaaaataatggataattacattgaggggaatttttccgtatgtatatgataacgtatacatacgtatgcagcttaatccacactgagttcttacttgtaaacgctaaggtcaaagggcagataatggattccagactaggagtgcatataaatggacacttggattcttcattagatggtcactgtatcagatcttagcaatttcttttgtaggattggcataaatgaaaagtatgcatgtacccatgcgatatgatattaatatgtatttctcattatttatgtagttttctaacaatatatggtgatatgaatggccaccattattctgtttaatatcaagtaatggacaaaaccattcttttcctgattgatgtagttcactgtaaccttcttgttcgtgggcacacttacttagatatttccttgcgcagttattatactgaatttagagaagcaacgcaatatttctacgtgatatctataaaaaagaatacttcacttatgcaagcatcgcctggctgtaatctttgcttcagaccatctgacacatgtacacagtaacacatagcgagctatgaaaagatgatggtgggttcgtggtatggctacgtagaagatatgcgattcatgcactaccaccgcttgacgtagttatccgaatgcacaaattagactagtatgtgacaacgctaaacatgcgttccccagaaccacctgcggttgttgagaggaataggttttgcgcttgtctatggacactttcttgaactcaatccaactgagcaacacttaacaatattgtcattacttgttcttacataaagagtaagaactacttgcgaaataaacggtaatcaatcaaatttagggtcataagttgtattcgcacaatatgcataagcactgactcaagaaagaagatggttttcgaatggggagctagcaaaaagagtcacccctaagtataaaaactgaattacaaagctcttcgactactttctgtaagtaaatcattcggaagtgcgacaatataatgacaaaagacgataagttacttctattaattgaactttaattatttggcttttattttttttctattttcttactcgcgcttttctttattaagggctttctcaattagatgttaataatgtcataaggcatcgttattccgctttatattggtaactcagcagtggtcattgccttcgttcacgaccctcccttattaatcagttagtaatagtgttccagttaactctgtatccttttcttcttcggcctgacaatgtctgattcatcacctactatcaactttattaatttcaatcaaaccggaacgtgtatttcccttggaacgtcgaaaggtttcaaaatattcaattgtgagcccttcggaaaattttattcagaggacagtgggggctatgctatcgtcgagatgttgttctccacctcgttactagccctcgttgggataggcgatcaacctgcgctttcaccaaggagattgcgtataatcaacacaaaaaaacattctattatctgtgaggtgactttccctacttctattctgagtgtgaaaatgaataagtctcgattggtggtacttttacaagagcagatatatatttatgatatcaacaccatgagactattgcatactatagaaacaaaccctaacccacgtggccttatggctatgtctccttcggtagccaacagctatttagtgtatccatcaccaccaaaagttattaactccgaaattaaagctcatgccaccacaaacaatatcacattgtcagttggtggcaacacagagaccagtttcaagagagatcagcaagacgctggccatagtgacattaacgacttggatcagtattcgagctttactaagagggatgatgcggatccaacaagcagtaacggcggtaacagcagcataataaagaatggtgatgtgatcgtattcaacttggaaacattacagccaaccatggtcatcgaagctcataagggcgagattgctgcaatggcaattagttttgatgggacactaatggctaccgcctctgataaaggtactatcatcagggtctttgacatagaaacgggtgataagatctaccaattcaggagagggacgtacgcgacaagaatttactccatatcattcagtgaggatagccagtacttggcggttaccggctcttccaaaaccgtgcatatcttcaaattggggcattcaatgagcaacaataaactagacagcgatgatagcaacatggaagaagctgcagccgatgattcatcgctcgataccaccagtatcgatgcgctgagtgacgaggaaaacccgacaagactcgcaagagaaccatatgtggatgcatcaagaaagacaatgggtaggatgatacgttactcttctcaaaagctatcccgaagagctgccagaacattgggtcagattttccccatcaaagttacatcgttgttggaatcctcgcgccattttgcgtctttgaaacttcccgttgaaaccaattcccatgtaatgaccatatcaagtataggctctccaatagatatagacacatccgagtatccggaactcttcgaaactggcaattccgcaagtacagagtcctaccatgagcctgtcatgaagatggtccccatcagggtcgtttcctcggatggatacctatacaactttgttatggacccggagagaggcggcgattgcttaatattgtcacagtattccatcttgatggattgatcacggaagtgtctcgcgctgccttccgtacgtcacaacgcatacacaatatagtttatataaactcctgcgtataatctatccttttgcataatattttcgtcaccattatcttgttgcggtgtttttatttaaaacaatagaactcgcctaaaggggaaattttcgatataaaatttcaaaaaaatggctttcatggatcgagtatttgtttgtcgaaaaaggatcactggagtgacgttactacgttacgaagcctccttccggcttagccctgttgattacgaatttggatcagttggtatttgattcctcggaagagttaacttcacgcgggtaaatcacttgtgatgcggtatattctctatacggctaatagatgaatcagggtgttttaaagtgcgtataaacccttttgctattttcgtttatataattggcgttgataaagagccaatatctattgttgctacatagacgcaactctcttagcaaaataaaaatataaaaagttcaacatgggcttcagcagcggtaaatcaactaagaaaaagcctctgcttttcgatatcagacttaaaaatgttgacaacgatgtaatactcctcaaaggtcctccaaacgaggccccctcggtgcttttatctggttgcatcgttttatcgattaacgaacccatgcagatcaaaagcatatcattgagactttatggaaagatacaaatagacgtaccattagagaggccccaggacgctagttcttcgtcgttgtcttcatcgccgccaaagatcagaaagtacaacaaagttttttataattacgcatgggataatgttaacctcaaggagtatctgagtggtttaagagggcaatctggccttgcgggcagtagctcatcaagtaatatcttgggcactcgccaaagagctcagtccacaagttccttgaagtctttaaaggggtcctcctcaccctcttcatgtactttagataagggcaactacgattttccctttagtgctattttgcctggttcgttaccagagagcgtagaatctttgccaaattgcttcgtgacatatagcatggaatccgttattgaacgcagcaaaagttatagtgatttgatctgtaggaaaaatattagagttctgagaaccatttcacccgctgcagtggagttatcagaaactgtttgtgtagataactcatggcccgacaaagtggattattctatttcagtacccaacaaagccgtagctattggttcagccacccctataaatatttccattgtacctctttcgaaaggtttgaaattgggctcaatcaaagtcgtattatttgagaattatcaatattgtgaccccttccctccagtaatttctgaaaataggcaagtgacagaacttaatcttgaagatcccttgaacgagtcatctggagaatttaatggtaatggttgctttgtaaataaccccttttttcagcctgatcattcattccaagacaagtgggagattgataccatcctgcaaatcccgaacagcttatcaaactgtgtgcaagattgtgatgtccgctctaacattaaggttcgccataagctcaaatttttcatcatcctaattaacccagatggtcataaatctgagttaagagcgtccttaccgattcaactttttatttcaccatttgtggcactttcaataaaaccattgtcatcctcgaatttgtattcgctttttagcaccactaaccagaaagacgaaaactcatcacaagaagaggaagaggaatatctgttttctagatcagcatcagtcacagggttggaattattagcggatatgcgtagcggtggctctgttcctaccatttcagacttgatgacgcccccaaattatgaaatgcacgtatatgatcgtctttatagcggttctttcactcgcacggctgtggaaacgtctggaacatgtactcctttgggaagcgaatgttcgactgtcgaggatcagcaacaggatttagaagatttacgtatacggttgacaaaaattagaaatcaacgtgacaatctagggctaccaccgtctgcctcgtctgctgccgcttccagatcgctatctccattactaaacgttccagcaccaaaggatggcacggagagaatcttacctcagagtgctcttggtcccaatagtggctctgtgccaggagtacatagtaacgtatcacctgttttactttcaagatccccagccccaagcgtgtcagcccatgaagtgttaccagtgccctcgggcttaaattatccagagactcaaaacctgaacaaggttccatcgtatggcaaggcaatgaaatatgatatcattggtgaggaccttcctccttcctacccttgtgcgatacaaaatgtgcaaccaagaaaacccagtagggtacattccaggaactcttcgacaacattgtcatcttctataccaactagctttcattcctctagttttatgagtagcactgcttcccctatttccataattaatggctctagaagtagttctagtggggtatctcttaatacacttaatgagttaacttcgaaaacttcgaataacccatccagtaatagtatgaaaaggtcaccaacaagacggagggctacttctttagctgggtttatgggaggttttctatcaaagggtaacaaacgatagtcgccgatattgtttcggctcgtgcattaagcttgtatagtttcatatagaaagtgatgtatatagcatttacgcactctaactggcattttaaagaaaaagggataaatgcaatgtttggcgtgcggcagtataagttcaaaaaaatccactgcattgttgaaaagagtcaagtcgatcctgctattggttttcagtttgagggatccttccatttgctagatatcataagataaatggtccaccataaagtaattaaatcttgaaattaaattcttatttcattagagacagagaaactatttattgtacattcgctaaattacattatattatttcgagctttgtcttgtttatatttagttacgttgggatcaagttttaaaaaactagatctggagtgacaaaaaaaaaaatacccagcgtaaggtaaatattatggatatgctttggaagaaaagaattttgagacttacacattattcggcacagtaggtactagaaagcatagaatcacattcgcctttaaagacattcttttttcttgctccttctatggactgcgacacaatagttgtttttgtgtcgtaccgaagaaaaagccttgtgcagaaagcaaaaatagtacacttctagccttgattaccaagagttatgacaaaaatttgcagttcagagtataccttaaaaactgttcctaaggtcaaataaagaggaaaataatcaaactaattattcattaattgaacgaaccaataataacgagagaatcagtatcacaaaaaaaatttcaacctacaagaggaaacatgtattctatttcaaacaaaaaaccttctatactcagtatggttcccctgaatattttgaaaaaccaggatttgaaagtaaaaaaagatcaagaaaagaaaatatcatttaaccccgtagttactcctattaggccagacgactaccacgaaaaaacatccagatcgtcaagttcgagccattctgattcacctgaatttttgagaattaacaacaacaaatccggtcacaagaatggaaaattgaaaagttttgaaagtaaaaaactagttccgctattcattggtgacctccatgaaacagttactgaagaaactttaaaagggatcttcaaaaaatatccctcttttgtctctgctaaagtttgtcttgattcagtgacaaaaaaatcactgggccatggttacttaaattttgaagacaaagaagaagctgaaaaggctatggaagaattaaattacacgaaggttaatggtaaagaaattaggattatgccatcattgaggaatacaacgtttagaaagaatttcggcactaatgtcttcttctctaatctacctctaaataatccattattaacaacaagagtattctatgatacgttttctagatatggtaaaattctatcatgcaaattagactctaggaaagatataggatttgtttactttgaggacgaaaaaactgcaagaaatgtgatcaaaatgtacaataataccagtttttttggtaagaaaattctatgtggaatacattttgataaagaggtcagaagtgttccaaattttgaaacacaaaaatcacgattagatgcggaaacaattattgaaaaagagcaatctttgaatgagaaacactccaaggggaatgataaggaatctaaaaatatttattcttcatcccaaaattctatattcatcaaaaaccttccaacaataactacaagggatgatattttaaattttttcagtgaagtgggtccaattaagtcaatttatctatccaatgccactaaagttaaatatctttgggcatttgttacatataaaaatagcagtgactcagaaaaggcaattaaacgctacaataatttttatttcagaggtaaaaagcttttagtaaccagggcacaggataaagaagaaagagccaaatttatagaatctcaaaaaatatctacacttttcctggaaaatttaagcgctgtctgcaataaggaatttcttaaatatttatgtcaccaagaaaatattagaccgttcaagattcagatagatggatatgacgaaaattcttctacatattctgggttcatcaaattcaggaattttgaagatgctacgagaatatttaactttttgaataaccgtttagtaggaggaagcatcgtcacgacatcttgggaaagacaaaataatgcacctaaatatcatgatggttatggaatgcgcaatatacacacctcttctcatccacaaattaccccatattaccagtactcacatgcgaatagtttgaactccccacacatgagagatctttcgtcaatgaatagcagcacaagatcactaataaagaataaaaatttcaataagaaagttttggaaacattcgaaaagcaagtaagaagaggtatagatttcatgagatttccaagtgccactagagacgaaaatgtgcacggaatagctgagtatatattcgacacttattggaatcgcgatgtgttaatcttggacaaatttttatcgttgctaaatagtagtccatatcatgaaggtgtattgcaaaaacaaattgaagaggctgcaagctcgttaggatttaaaagatgaatgtctctttgttaatttagctagagttttccttatttattttttttatttacactaattcaatctttttcgttatatttagatattattaaaaattattattatggaaaaaattcttaaaaggatagacagagggacgccgtctgctatatgatatgtatttaggtccgagtgctgataaactgtaaggcaaaaggtataagtgtaaatcaataacgtttctcgtattctttactcttcttcaactttcttaaactagttcaacgtaatttgctgggaatataccttctctaccgttgactcttccggtccaccagtcattttgagaatctgattttttcaaaattgtgatcacgtcaccctttctgaatggtaaatctccggactcttctcctgcaaagctatataatgccacggcctttggagaagacgtggatggggatgttggagcagtgaatctgccctgactagtttgcggtgttgaagcggacgagattctagatttagaaaatctgttcgacaagtcatcgacttcacggtcttttgtcctatctcttccattcccgcgtctatacccggattcataatcatcatcataatcatcgtattcatcatcagcccaacgatttcttgaagaacgagcccttgactgagcagttcctgatcttctgtggctggcataataacttgaagctccagatgggtcatccagtttaccaccactaccaccactgttggtaggagccagtcttgaattccttgaatagccagtaccataatcatcatcgtcgtcatcatcgtcgaacgtataacgagaaccgctttgggctcttctccttgtggatcttgtgttaggtctagtggaggaagcatctgtagaactgaatgaactaggaatgtcattatagtaatcgtcgtcgtcatagtaatcgtcttcgtcgtcatcgaaactgccacgaccaccgttggagggtctgtaattaaacgccctggactctaaaacacgaaacaatggatcaacagctggaggcggtcttatcctaccagacaaaatcattttcgcggtacaattgtcaccataaaattttctgttagcctctcttctttctataatagccgaaccttccacagaaacccctgcaaatagacctttactcttagaataggcaaaaactgcagccacaccaccggcggaggctgatgcagctgcttctgcacttctaccaagaggcccagcagaaacggagacgttaccacccagcgtgatggtcccaaattcagaaaacgacttaacagcatcctgagtatttaaaatgaaaacaaaatcagtcaattctataccaaccatcccaccggcaccagcacctgccatggcaatggcagatggagctgaccaagtaccatcttttaatcttgcgacaatcacaccagaaccagctctacctgaaaatagaaaacctgcctttaagatcgttatgatagccaaccctttagctcttttcaaaacgtctggaggaatgacttggtccgcaccaaaaacttgatttggtttgacaaaactagccaaaatcttcgctgcttttctttattaattgtttattactagttagtaaatgatgaacaaattaagggagaacttttttaaaggtttcccagccaaacccgtataaaacatactttgtctcactctttaaactccttggaataggattgttaatacccattgcgtgtgatacagcttttgtttttgatttctttgccacccgtgatccaaagccgttctagatttcttcgatagtttatactctttcatgttgaacttccagatgcggccgagtcggcgagcaaacagggtgctgctactaaacgaacaataaagaaagacaatttgggcacccaatataaaatgagcaatcaaatcaatcaattcagtgtgaaatttttttcttggaaaggtcattcacttctacacagctgtacatgagtttatatgacagtttttttttttatgtacatccagttcaagataatcagattatatattggcccaaaagggatcattaacgaattgcgaaatgggtaatctctttacagttaacacattctctggtgattggctttcctcaaggtagcaaatgtactctaattgtagcacgtctactatgtatttctttaccttgtcatagcacacacccacttgcgccacgccgtgtgcgtcatcacttagaacaaatctggatccacagtgcttcttgaccagattacataaggttttgctggggtacggctcctcgaggccctttcttaatgcggacgtattgatttcaattgcgccgccataggagtctataaattgtaaatttcttacaactgcatcgtatatttctggccattcactgatgacgtccagtgaagctacaggaactccggtttcttcgttgcagttgcccgatttctggtttactagcatgtcattgggcaaaaataatttgtaaaggtcgaagtgacccacgaccaacggtttaatattgatcagcatttcgtactgtgattggaagtaagacaggagaaaatctttcaaattatcattgaaggaatgcaatgaattgtaccattgttgttggtcgaaatcaatagggatcccgttgacgtgatggaccgaacccacacaaaacttcaaagtatcattattctccttcatgagtcgctttgcatattcgatatgagccatgtcacaactttcgatctccattcctataatgaatttagtccgcacatcgggtctatcagcgtaacgagtcttgatttcttgcgcatgactcatgaaattcttgaacgatgtttctagcttgcttatgacttcctcaggattcttgcccaatgactgctcttcggggtatataaacttggcctcaattcttggtatgtgctctgtcaaacagtacgtgtgaaagttgaggttgaccacctgatcgaccacggaatccaaagggtccgtaccgtgggcactatagtcaccggagtgtgaatggtgtgagtgcatgacctcgaggatttttgctcaattgtacgtatcaagaagtactaaaatgtgtttaaaaagggaaagattgtacggggaatggaaaatgtacatataatatccagtatcatttgagttgatagagattatctctatagatacgatatttgacaaaaaaataaaaaaaatttaaatggacgagtccggaatcgaaccggagacctctcccatgctaagggagcgcgctaccgactacgccacacgcccgcacgtttgttgaaatcttccaaacagaaatgatacaggtttactttacggcaagacattactagtttcattagcttatcaacatgtatgaaaccggcaagattgaaaccttgattgcccttgacgagctactcaaatgtgtaaatatctgcacaatcagtttacacccatgtttccgcgagaaatgggggaatgttgagataattgttgggattccattgttaataaaggctataatattaggtatacagaatatactagaagttgtcctcactgatcctgaatccaaaaaagagaattctacgtaataatattatcacctcttcctccattttatatgctgtcattcattatcctattccattaacaatccttgcatttcagcctccattaaatccgatgattgtttctcaacttttatgccatcttcttatacccatataatgatatattagtaggaagaaacactaatcgatagatgataattatcatttacctacgcattcgtattatcgtattcgcagctagaggccagtgcaaccatataaatattgctattaacttcattgtagctaaagcaccctgggtgttaaggagaaacatcaataagagaatagtttgtagtattctgtgaaattttcggtgaccatggtcttcaaggagaattctttagaatattctatgtatctataactaatttccaaaaaatgacatgtcaatcactttccagagctataagatatattcaggtttatcccaaaaatctttacagagaaataacccttgcaaaaccttttggtacacgaacaggcccctttaaaagtttcttggcagtttttttcgtcttccttcttttccggccatagcatcgtttgcggatcgttcaaactcctattatccgataagctacccaactgccctcccattaggtagtggttattggggcacttattgtctcttgtggtgttgtagtaatggttaatataattttcgagcaaatagagtgcaacttgcggttcgagttcaataagattaatatccctcaatgactcaggaggtccattccagagaatagaaagtagtgcagttgcatactgttcattagtaccgtctccatttttgcctctgagatttgatggcggaaaagcgacacatgaattgttgacctggagtgcgctcactgttacaattagtaaggccacggtaattgctactgcatagggcgtcatcaccttttcgaaatttgacactgctaatttggcgccagtatagagtttctttctcttgaatccaatgagatcattatcctagtatagagcttgtaagtccaagctgcacttaaatatacaacgatcagaaaaaactcgtatagtctgttgaaaatgcaacacgtatacctccggagaagtatctttggttttgatttgccgcgcagcctgtgtaaagtggcgcacacaatcacgttacttgaatctcagttcagaagtttctttcaacacagccaattgcatttagtctgttatgcttaatattgtagctactacgtggcaaacatagctgcccgaactactttatgcgtacgtgttcacagcaatttgtataacgactcaatcaaaattctctcaaacaccttcatgggaatctgtcgacaatgtaatcagatctcagcccaattgctagtatgtgttcatatcttattccgtggccgcccctccaaaaagcttcaaaatacactcaccaggcttagttcttgttgggagaagaaccgttatcgttcacttgataatattcctaccagtatgttgtcctatatggagtcatgagcatacatggtgcaaaattatggaattagcgcaatgtgtttcaaacagcaattggatctttttatagacactgaaatgccagaattgataatgtaataggaaaaaaaatgaaaagattcaaaaccgaagataaaatgagattatttttttcttttatgtagaaacatcgattcgcttctgtgggttcctatatcctcgaggagaacctctaatatattctgtataatcaatattatagcattaacaacggtataatctcagtcattatcccaaaattcacctattttcccatcataccgatctttgcgaatacttgagcatgtaaatcagagattctatgtaacagctgcccagaaaccagaaaacgtctcttaaccacttccattgttggcatgttgaaacctcctgccgccttgatcatccttcaacttagggaagaatcttaacaaatgaaatttaacgtcaacgcgtaatagaaaaaaagcctttcgcgtactgtaaccagtaataatacataaggacatgccagctacaacggacatcaacatatatctatgtttacatattagggttcaacagaatataaatcgttgcacaaaatgagagctaggaaatcgcaaagaaaagcgggcagtaaaccaaatcttatccagtctaaattgcaagttaataatggttcgaaatcgaataaaatagtcaagtgtgataaatgtgagatgtcatattcctcgacatcaatagaagatcgcgccatccacgagaaataccacactttacagctgcatggacgtaaatggtcgccgaattggggttctatagtatacacagagcgaaaccattcaaggacggtgcatctatcaagatcgacagggacaataacgccattgaactcgtcacctttgaaaaagagtagtccgtctattacccatcaggaggaaaagattgtatatgtgagaccagataagtcgaacggtgaagtccgagccatgacggagataatgacgctagtaaacaacgagctgaatgcgccacacgatgagaatgtcatttggaacagtaccacagaagaaaaaggcaaagcgtttgtatacataagaaatgacagggcggtcggaataataattatagagaatctttatgggggcaatggtaaaacatctagtcgtggacgttggatggtttatgattctagaagattggtacagaatgtgtaccccgatttcaagattggcatatcgagaatttgggtgtgcaggacagcaaggaagttgggtatcgcaaccaaattgattgacgttgctagagaaaatatcgtttacggtgaagttattcctaggtaccaggtagcatggtcgcaacccacagacagcggtggaaaactggctagcaaatacaacggcattatgcataaatcaggcaagttactattgccggtatacatatgactcttacgaaaagacagcgagaagggacactggaaaaatgacataaaacttttcaaggttattattagtaagtttttttattatatgatatatatatataaaaatgaaataaattatttcttgatggagccacttatttttcttataccaccggcggcgcttgtagtccttctccctgacgttactctcctattcttgggcaatagttgtcttagtatggtatcatctgcggcattattgatgttcgttgcgctgggttcgttatcttccattcgggacgatgaagcagaggagatatcatttttcttgcgcgaaactttgggataatgattacttgtgccgttggtatcctgcatggattcgtcatccgagttgttgctttctattactaccttcctattcgcatgggaagttggattacgattattgttgatatcttctatagtattagaaccgttttggccctttctcggctgaccaggcgaagtctgtgggacggctgagctcttgaatgaattacttccattattcgccgtagaaggttggctcgaatttctggcactaagcgccccatgaccgttggatggcggcgtcatggttaaatctcttaattcaccttcaatgttattttgcgcaaccctcttgtcgtctttaagtttctttttttgtaagcggtattcttctaaacttattaagggatataagccgccaatggcctcactaggcttcaaagaaattctggttgtgtacttccattctctaaaatcattctggtgtaaatataaccaatgctgttgagggccaacgaccattcccggccttataaaccttaagaagccaatacactcgttagcggtaaatccatacgtgtatattaagtgagcaccaattaaacaaccagttctacctagcccagccttacagtgcacagcaattttccctccccttttaattatcgtttcagcagcaccaacaaagttttttacaatggaaagatcaggacatgtaccatcttcgaaaattagatccaaatgttgaatgccaatgtcttcaaaatgctttttattatataaatgagaattcaaccttaccactaattggacgttattgttggcgaaaaaattcagaaccgacttaaacggctggttcaaatgtgaagatttggtagcgagatagccctttggatggtcctcttgtggtgacgcaaatgcaataaaatctggggtgagtacattgaagtctccaaactccacgtgttcgtatttctcgtaactctccaaattgaaggaatgcaaatcaataaggcctttttccttagccctccaaacgccataaaccacatcttgaattgtgatttcgaaatccgcattagaataaccggcatctctaaatggcatgaagggagggtctacttgcgccaacggctgaagcacttgatgcggagtccatgcctgaacgaggatcatataacagcaaagcatacatgcggcgttagcacgttgtctggtcgatgcagatgaatagaaaacaacggctttattggcattttctgggtcattcaagatttcatggaaaataacggcaaaacgatatagatgtccaatgttcatgggaccgaaatccaaatggaaactgttgtaaaagattgcgtcctccacggtaaaaaacaccagctcatcagtatcttccggcgtgtaatcatatgcaccgagatatactctgcctcgcaggaactcgatcgtgttgtcgaggtatacactcctacgcatttttttttttttttataagcgtactttgtagtcccagcctctgtgcaattgtttcgtattatacctcgaacgaatcggaaatatttggtacattattgtttcaatttcaatttgtttacctttgaaccaagtgaagaaaaacttatggtgctaaaagtacattccccgttgaaagtgatacagctttcttgattgacacaatagcaatggccttcaaatgcatatctctactatcggctaaaaaacgaatgactcacgttatcaggctcatagcttgtgtgtgtgtgtgtgtgtgtgtgtgtgtgtgtgtgtgtgtgtgtgtgtgtgtgtgtgtgtgtnnnnnnnnnnnnnnnnnnnnnnnnnnnnnnnntgtgtgtgtgtgtgtgtgtgtgtgtgtgtgtgtgtgtgtgtgtgtgtgtgtgtgtgtgtgattgttgttctagtcgcttgctttataaagtaacgacactttctggtgccaatatgtgaaaacgcattacagaaaaaaacagttgtattctactaaaaacacatcagtagtcacagaagtcacagaagtcacgtatataagctagtggcaatcataactaacacaggtgtattaatgaaaaaataaagccaaaaaaatttcagaaaaaaatatctcccgggggcgagtcgaacgcccgatctcaagatttcgtagtggtaaattacagtcttgcgccttaaaccaacttggctaccgagagtcgtttttgttgattactttgctatataaagattcctttatcattatttcatgaggcgcacttttgattttcacacctttttcaagcggaggagttattcgtcttattaacattaccattacagtagtcatcaatgattaccttatcagcactgaaaagatacccgtaaaatttagcacacgcacactcacacatacataggtacgaaatacacaactgataggcgttcatgcactctcatagacaaaagtggggccgccagacggatatagcgagggtgctcgacgatatagaacacgacctctatctaccgcaacggctatcactcgatggtgcaactggtactgacgaatcacatgtgcaatacggtatagtcaaagactgctctgtgcttacgtgtggctgctgtatatctgaatcgctattcaatgatttatgcagggaaacttcgaacaagcaaactgcgtgtcccatctgtcagcgagaaaatgttcgactactttcagccatcaagccgctgcgagatttggctcgtcagattgacttcttcagaagtactaccggacagggcgaaagcgaaagcgatgagctccccgctatagtaaagacttcaccatcatcatcatcactatcgctaacgccatcgcgctcttcctccactgctgggctagaagctgataacaagacactatcagaccctacagttaaggagaaatcatcactgctcgaactcttccatattgtggcttcgaagatgcataatgcgaatacagaggtagggtcggaccacccactcacgactggcaccacccgtgatcaagaagaacacaccactaaggagaattactcaagcagcttactcgagcccaactatgacgaccacgcgaactggaaaatcctggataatgcctcgaacacaagaactgtgccgatagataacaacttctctttgatgtctacggacgttacaataccttccacagcaaactaccaaacaaatagtgcacatgatctggacgaagaaaaggagtacttttttgccaactgtttccccatgtacagaaaaaaatttcagttcaacacacaccccaaattcctagggacgaaatccaaattattcatcaaccaaagcatttctcccgattgcaccaaatttgctctaattactgaacacaagtgggaaatttattcgattaatccgaaggacaactctcctcaactagtatcatgtggcaagtctagtggagaatatggtcccaacttcaaccaactaacagagcaatcgtcatcttcactctccactacttctcaagcgtcaaaaaagaaaaagaaaaactggagccaacgtttttgcaaactttccaatgatttcttgataatatcgggttcgcaaaacattcttaatgtacacgacatacaccaaaacggcaaactcatctatacctacgtgtcgagattccccatccgatgcatagacatagatccaaggtcgcagataatagcctacggaatcaccggaaaggatagacatacaggcgcggaacaagcattagtcgtgatccaacaaattaccagaaataaagtgactttggagcccgagttccccccaccaatcaccataacacttccatacagagatcccatcaataccatacaactttcgcacgacgccaagtatctgacatgttcgaccgcgctagagtcgcggttcttgatcatatctttgcagaaaataaacgaaccaagactgataatgaaaagtgttcggtccatagacacttccttagaatctgaaggtatcactgacacaaaacttttcccaggaaatccaaatctgatgtgtatcacatcaacagcattcaattcatctccactggtcataaacaccaaaatcacccaaattaacggtgtacggaccgtggcacaaccatccatgcttataagggtagatgagattggatgcaagattcacaagtgcgaaatatcaccaagaaacgacgcaattgccttcctcgaccgcaacggatcagtttacatcatgtgtgcccccaccatgatggacaacaacgaaaaaagaaggacaatcctcgttgaaaccgtggcaaatgcctacagggcttatgaatcagctactttgcggtttaacccagagggcaacaagctttatattctcgacagaaaggggactttctttgtggaagactttgcatatggcttgccccaatctcgcgaaatcaccaaatgtaagcaaatattccacaaataatgcatctaaatatatacgtatgtttaaggttctggtatacaggtattaaaagaaaacactatcaacattcccaataagatataccacaccacgtgagcttatagaagcacgtgaccacaattcaccccacaggtgtggcttttttggtgccgtagaaaagactcattcatgaatcgtcggaaacccatagtcatcttcgagcaaaaggtatatataagcaacagagggcagtagttctcgagaccaccatcttttgattggaaatagtttcgtttagatggggtgcacatagtttttttcaactgcttttcctcgaggtcacccaaatatacaacgagatgccagttgagtttgctaccaatccttttggcgaggccaaaaatgcaacttcactgccaaaatatggtacacccgtaactgccatttcatctgtgctgttcaataacgtggactccatttttgcttacaagtccttttctcaacccgatttgctacaccaagatctaaaaaaatggtctgaaaagcgtggtaacgaatcacgtgggaagccatttttccaagagctggatatcagatctggcgctggtttggctcctttagggttttctcatggattgaagaacactacagcaattgttgctccagggttttcgctgccatacttcattaactctttgaaaaccgtctctcatgatggtaagtttcttttgaatgttggtgctttaaactacgacaatgctaccggctctgtcaccaacgattatgtaaccgcattggatgctgcttccaagctgaagtatggtgtcgtgactccgatttccgctaacgaggtacaaagtgtcgccttactggcattggcgattgccactttcagtaataactccggagctatcaatttatttgacggattaaactactcgaaaaccgtcttgccgttggtcgaatctgttcctgaggcatctattttggcaaaactatccaaagttattgcaccagatgctgcctttgatgatgtcttggataagtttaatgaattgactggattgagactacataatttccaatactttggtgctcaggatgctgaaactgtgtttatcacttatgggtctttagaatccgaattgttcaactctgcgattagtggtaataattccaaaatcgggttaatcaacgtcagagtgccattaccttttaacgttgctaagtttgtcactcacgttccatccactaccaaacaaattgttgttataggccaaactttggatggttcttcgccttctttcttgagatctcaagtttcagccgccttattttaccacggccgcacctcaattagcgtttctgagtacatctatcaaccagatttcatttggtccccaaaagctgtcaaatcaattgtatcgtcattcatccctgaattcacttacaatgccgattcatctttcggcgaaggattcatttattgggcctctgataagagtatcaatattgatgttgcctccaaacttgtgaaagctctgtctttggaagatgggaaatttgtgtctttgagaacgaaatttgataacttggctaatgctggtaccttccaagctcaatttgtgacctcgaaagaacagatacctgtttcaaacatcgattctacgaaattatcagtcgttgaagatgtcagtttattgaagcatttagacgtagctgctaccgtcgcagaacaaggttcaattgcgttggtttcccaaaaggcagttaaagatttggatttaaattctgtagaaagttacgtcaagaatttgggaattcctgaatcattcctaatatctattgcgaagaaaaacatcaaattgtttatcatcgatggtgagaccactaacgacgagtccaaattgtccttgtttatccaagccgttttctggaaattggccttcggtctagatgtcgcagaatgtaccaaccgtatctggaaaagcattgattcaggtgcagacatttcagcagcctcgatttctgaatttctcactggtgcattcaaaaacttcctcagtgaggttccgctagcgctgtacactaaattttctgaaataaacattgaaaagaaagaggatgaggaagagcctgcagctttaccaattttcgttaatgaaacatctttcctcccaaataacagtaccattgaagaaataccattacctgagacctctgagatctctgatattgccaagaagttgtccttcaaagaggcatatgaagttgagaataaactaagacccgatttacccgtcaagaacttcgtcgtgaaagttaaagaaaatagacgtgttacgcctgctgattatgatagatatattttccatattgaattcgatatttctggtactggaatgacttatgacatcggtgaagccctcggtattcatgccagaaacaatgaatctttggtcaaagaattcttaaccttctatggtctaaatgaatccgatgttgtcttagtccccaacaaggacaaccaccatttgttagaaacaagaaccgtcttacaagcatttgtggaaaatttggatattttcggtaaaccaccaaaaagattttacgaatcattgattccatatgcctctaacgaagaggagaagaaaaaattagaggatttggttactcctgccggtgcagtagatttgaagagatttcaagatgtggagtattatacatatgctgacatttttgaattgttcccatctgttcgcccatctcttgaggaacttgttactatcattgaaccattgaagagaagagaatactcaattgcctcctctcagaaagttcatccaaatgaagttcatttattgatcgttgttgttgattgggtggataataaaggaagaaaaaggtacggtcaagcttctaagtatatctcagaccttgctgtcggttcagaattggtcgttagcgttaaaccatctgttatgaaattaccaccatctccaaagcaaccagttattatgagtggtttaggtactggtttggcaccattcaaggccattgttgaagagaaattatggcaaaagcagcaaggttatgagattggtgaagtcttcctatatctaggttcaagacacaaaagagaagaatatttatatggtgagttatgggaggcttacaaagatgcaggtattatcacacacatcggcgctgctttctcaagagaccaacctcaaaaaatttacattcaagatcgtatcaaagagaatttggatgaattaaaaactgcaatgattgataataaaggttcattttacttgtgtggccctacttggccagttccagatattactcaagctttgcaagacattctggctaaagacgccgaggaaagaggcatcaaagtcgacttggatgccgcaattgaagaattaaaggaagcatcaagatacattttagaagtctactaaattaatatagtaataaaaactaaatatctatttattgaacctgtcttgaacatttctatttttttttacttttagttttcttctatgcgcaagcttttctattggctgccaaatagaaaattattgaaatatgattacattacaatatttatttgtcttatgaaaactaaccatcacattatactaactacggaggtaccatcttgaaatctcgtcctgaagaccctattagcattggcaaacataccttctttaagcgagactacaatgaactgagatcctttaaaccttgttttaatcaaatgacctatattttgcgtatgacttaaatcaagagcagcatcaacttcatccaaaatatacataggcgctggtcgaaattgcaacaatgccataatcaatgacaaagcaatcaacgacctttgcccaccggacaattcaatcaaactttccttccatatattaccaagctttactttaacctctaaaccctgcgttacgtccttaccttcgcatggaaccaattttgcaaatgaatttggtaaaaggtctgcaaaaatattaccaaaatcaagtgtcactttctcccatgttttgactaaagtttctcttttatattcgttcaacttcgatatagtctcttggattttcatcttatctttttcaatcgttttaatcattgtttttaatgctgcctcctttttctcaacattttctatcatattcataatatttggattaactttttttctgagctcttgaaacttctcgttcaattgtttactcctttctctgtaagtatccaaatcgataccctcattttgtttgacgatatttctcaccagatcaaaatcctcaagaaattcgtgtttctgtcgcagatcttcaattatcttttccatgttgttcgtattagacttatatttgttcaagtcatggaccaatttttgtagttctaattcactgctttttttctcgtcctgttttttctttatcaatgtttctaattcatttagttcatcatcaatgtccatcaaccttttcttttcttcgttcagttctgtctggactgttacaaggtcgtcttcaacacctcgtatctttccctccaaatcagaattttccaatttcaaactttcaatagatttcaaatggttatgcaatagcgtcttattagaatctagttctgagctcaattgctctgtttctaattccaagttttgaaacaagtcatatttacgttctgactccgattcctgctcctccagctctttcgccaatagtttcaattccttctttaattcatttaacttggatcctttatcgctatcgtactccttcatgtctttttcaatggtcgaaacttcttcttgacatttctttaagctcatttgcttggttttgatttcattctcacactctccaatgtccctcaaaatttcttcattcctagcaattatttgggaagatggattcgcgtcgagattacgcttagccaaatccaatttatgcaacgagagatttaaatcactttgaatggtctttgttttttgcgatgtagcatattgcgtctgtagctcttccgttacatggttgagatcagcctgaatggtctcaatttgtttttgaatttgattgtatttttgaatatcaactaataacgattcagaggtatttctactaccaccagacaatgtaccctctgggtcgtatacatcaccttgaagggtgatacttctagcgcggatctttggatggaaggtaattttctttgctgtttccggatcttcacagattaaactatttccaaaaataaattccatcgctttagtgatagattcatcaaaccttattaaatttattgccaattcaactttcccaggagcaattttcttggctaaatcaagcacttgagaacttattggcctcgtatatatcttatcaagaggtatgatggtaacacgcttgcgtaatcttcctctttctaatagctgagtggccgtctgagaatcttgaacaacaacattgaatagcctacctccggcacaagtttgcaaagcagtagcatagcgaatattatcattatctatctggaaaagttgacccaccaccccatggacaaagctggcttcaaaattaggataaggtttcgtatagttaaattccagatttgttacgcgtctttttaaatattcagagttcttacatgtttgataataatggctcttcaatttatcctctctttgcttcaggtctttaattcgtgatggatcaaacccatattcgactagtcgggctcgtagtttatcgcacgtttcttggcattgtttaacatgcttcacatttaactcgttatctttcgtggcctcctttaatttaggttcaattgtcaatagctctttcttcaacaactccattttcatgcttgatttttttatcgccaaggagacttcattcagctcagtctttgccttggccaactgtgcgttataaccaccgtctgcggcaccggtcgaggaaatacctgtggttaaagtggaaactaattcttcttttcgtttataaagatccctttgtttactgagttgttcctgcaccattttataatccttttcagtgttagcgtatgccgattttttttcgattagctttgcagaggaacttgcaatttctgactccagagcctttgatttttcagtagtatcattcaaattttctacttttatcgacagtgaagttttcaaacgagaaatttcatttaaaagaccgttctccttattttccaacttggagattgtgccttctttgtgtagttctttttctttctgaagtttgatttcctcgacatcctcattcaaactgtctatttcttcggaagttttcttaacaaattcatttaacattttcatacgagtctcaccgttctccagagtttctcttattgatgtatgtttatgtttaatgttatagtattcataggatacaacaattcgttcagttttttccaaatcagtctgagtagactgaaattctaggaacattctcttttcgtttcgaagtttttccagtttaggttcgatctcttcagttaacagagtcctgttctcctgtaatttagtttctttcttagacattgttctttctgccttttccctacgatcctcgaacatttttgtccctgctgcctcttcaatcagtgataagatctctgagggtttcatattcaaaaccttggtaattttaccttgcatgattaaaaaattaggattattgatatttaactgcacggattgaaatagttgcaaaaccgactgttgaggtgccctatgcccatttatcagatatttagaagttccaccaagcacgacttgccttgtaacagagatttgaggagagttagtgaacccaatgggagaatttgatttatcggtattatcaaaaacaatggttacgcttgccttggtaacacctgcttgaccacgcttatagatcaaatcttgcaggctagatgctcgcacagtgctcattgatgctataccgagcacgaagcaaatggcgtccaaaatgttcgacttaccggacccatttagacctgtaatagcattgaattgagggtcccaatcagtaatgactgttcttgtagcgtatgatttgaaaccatcaataatcaattcctctaccttcatgcggtaacgatactaaaattgacttgtatttacgtggtctgcctcgagatttcttgactgcaccgtgtgtttactgttgttgatcttaaaattagaaatgcccatcatcagagccacgcaacacggtaatcactataaacgcgtaaggcagaaagccattttattcaagaagtcaaccccctccatgaagcaatgcttcacaggggagaaggggggagcttatgagagtatattaaagtttactttgaagaaatattctattactacagaacaaaatctaatttagaaatttttctttaaaaataagtgttatgttatattgtattgtttgctttgaggaattttttgagttatctttttttttttagatcttgcttaaagaatgactattttacataatctaatcttgggtcttttgagaaccacgtaacaaaccagttcttctggcggcaatcaaaccggccttttgaccagaaacagcacctctagagatggtagaagccttaccaatatgttgatggttaccaccaccgtgagggtgatcaactggattcatggcaacaccacgggtctttggccaagagtttctcttcaatctgtacttgtggaaagcacgaccagccttcaacaatggtttgtcaactctaccaccaccggcaatgacaccgatgacacctctggcatcagaagagataaccttcttggcaccggatggtaatctgactctagtcttgttttcgtctgggttgtgaccgatgataataacgtagttaccggaagctctggctagggcacctctgtcacctggcttttcttcaacgttggagacaatggtaccttctgggacagaacccaatggcaagacgttaccgacgttcaaagaagccttcttaccggcgtaaatgaattgaccagtgtggacaccttcgttagcaataaagatttcttcacgcaatctgtacttgtatgggtcacggaagacaaccttggccaatggggcacctctaccggagtcgtggacaatttgcttaacgataccacgaatgtaaccgtgacgttcagcataatccaaagttctcaacttggcagcaccttgtctcaatctggtgtgggaggtaaagatagaaccagcaccctttctttggttacgaataactctacctgaataaaaaataatgagaaaaaacacagttctgttagtatacacgatacattttcaacaaaaggaataaaaagactgtaaaagggtgtgatgacattgcgccattacgacaatcacatggttgttaaatcacggtgctgacatacccattgcttattgatctaatggtttcttagtttgctcagaaatggttattagtcgctaaaaaatgacccaataataaaaaaaacgaggtaatgatattgaaggaggggaggggcagggttcaatcgattatgcctatgcgatagtgcattgcgtagtaatccataggttcacatccatgtgcactggtgctgcgtttggcaattcccatactattccagattgatctgatcgtgcagagcaatgccaaaccatcgaccgtaggcccaacggtgaaacaatacgcggagaacgcttagccgctaggcagaacgcctagtttacacagtgggagaatgaggataggcctctgcctacggtaccttcgaatacagggaaagtgggaagagtgagctgccgaagtgaaagaggcttacgcattttttctttgggaagcggacgcaggactaagctcatcattttcgaaaaaaaaagaaagttggagccggaaaggaattgggtgttaaaaatgtacgggtgaaaaaagtcttattttgtcttaaaaggggttcccccagccgcaaaagaaaagaaaagaaaaataatagatcaattttagtttacttagcaataaacgaatatatgtattttatgttaagttctcactgtttatacccccttttcaattttataaagatctaagtagcagccacggttggacgatcggaagacgaagcaggcggaggtgggacatcattggtttccgcattgtcttgcccttcctgcacttgctccgctggctctactggcgctggcgctggcgctggctctgccaatgctgctggaggtgggtcgcgcgcattggttaagttgtccttgaccaattgtttaatttcttgaatcttagagacgtaagcgggcttcactattatcgatttgcccctcaaagtagctgtcttggccacactgtcacaaatgtccccaattggggtttcagattgcaaagtgaccaaagcggcagtaatttggtgtggagcaaaaggaatacactttctcctgtacaccttggacctgtaaatccagatttcttgaggcgagtagagctggaacaactcacggatctcactgtcggttatatcgtctggcaggtcgtgacagtaaaccgtatccgcggcagtctctggtgtcttcttaaccttatttttttctttgggcttctttacatccgtgtctggagtagagtctgcctcgtaaggaacgtgtaactttagaaatagtttctgattttggaaaacggttccgttcaagtcttgaatggccttcaaagccagagtattgtttgcgaactgggcaaatgctatgcctagtggtttgcgagggttgctattgtgccttttgctgaatctgcggacggtctgcgttggaatcaacactgaactggcgccatagttgtttaggaaggcatgtaggtctcgctcactcgccgtgaatggcaggttcgaaatgtaaactgtggtaatggtagtggtagtgtcactggtagtgtcattgttaacttgttctgtcattgcgggcttgtttgtatgcttatgtgaggccttatacttctctatgtgttgctactcagtagaaggtcaacaccattgttttatacatcatttatcttttgttattaatttgtgacgcttccattttgtggcacataaggaggaaaaagaaaattaaaagaaaaaaaaaagaaataaaaaaagaaaacggtactggatattgagataaattttccttcaattaagataataaaacatgttatataaaatcagacaaaataatatgtaaatttttaacgtattataatcttaaaaagtttatttcttggcagcagccaaagccttagcagtgccgtgtagggcatgcttgtggtttcttctaaactttggatcaacacctttcaaagaagggtacttgtaggtctttggcttcttgataccgtttctgtgagcctttctggtttggttgtgagcggtatggttcttagacttagccattttctggagaagacgatgaatgtacgcagaaattgcgaatggtcattaaaggttagtaaaaatgattcataacggtggaggggagtagcgtggcagctaactgccaatctgaagtggtgctagcgggggcaacttcgaacaagggtatgctaaaggtaattgaacgttcgagaaagagcgttcgctataagttcaaacactggtaactttccattattttcccttctctctttttttctttatatcctccactatatgccactcagcgcacctcagatttggctacctgcatttccaatgggcgaaatggggacttcatgataatataacgtactttctaactgtattgttgttccggggttcttgaatattgaatgaaaaatgttataaaataatgggttgaatcttgaaatatgcagtattgaaatattctgaaattgtatgtatccagagattatggcaaagcctaaagggaaaatggtagacttcctacattgagaatatcgctggttttcccgagcgcggctagcgaccatttttctttgtccttacagaactaaaaaaaaaaaccaaaaaaaagtcgaaaacaagaatacatgcgctgtatgggtctaagagtatgtacggatgtaaaagaaaacagtactagacagagcgcataaaaaaagcctaatcccttttccgtctgtatacttgtgctcccttataaaaaaaattaaaaattaaaaaataaaaataagaatagtgtataaaattatttttgctttgattttagtttatttatttactttctaaatacagtaggttaaataaggatcggtttcttgaagaaattgtaacaagactcagaataaatatgaatatagggaatatgacggataaacagactactttaatttgtcaaataatctaggtgccgtggcagtgtccaaatagtgctgtagatggaaaaactcctccacacagtcctccttgtgttcaagatccgcgtagccgggttgttgttgctgtatcttgactctctcagcacactcctcgtagtggtgcacaagggccttaccctcctccgtgttcttgaaatgttctctcaaatcttccaactgatcagtgacttcttcctcttcttcctcatcttcgtcgtcatcatcatcatcatcttcgtcttcgtcttcatcctcatcttcatccccattttcttcttctttttcttctccttctgctgccttttcttcatgctgctcgttatcgtcatcttcggccgcggccacaacaggcacaacggttatctttagttgttcccagtactcaccaactagttccaacatgcccattttctatttctttttctttatccgtgtgtgtaggtgtaagtgtatatgtgtgcttctgttaatgtgagtgcgtgtatacaatatgtgcaaataagcgccaaccaatactgcccttaagactgagtaggtcctaatctcgaaaacccggtgtgggccactttccagcaaagcgcctcttataacaagcaccgcgcaggggaggcgcgccccagtccgatatgcccggaacgtgcttcccattggtgcacggtcacgtgctcacgttctgctgtaggtgacggatgtaccggcaggccgcctccacggtggtcgctttggacggcgcggccgacacattttgctgtttccactccgcggggattaaagacgccagttcgtgcagcgcgaccgctaatcgattacgccgtgcttgctctgcatgcttgtgtgattcgcgcttgtcatcgtccacgagcgcgcccgatgaccgtcgcttactcagcgaccgcgaatggctcgatccgtgcggcgcgattacaggagactcacttgctacgaccacgccttctgcgctgctgctggtcttggccgtgaccggtgatacgcgtcttgtgctgttcgacggcagaataactttcggatattgctttggtttcggtttcggtttcggagttgggataacgctgtcgggcaattcgaacagcgaagtggccgaatccggcccgggtttacctctgcgcttgttcaaatacggactactattactcttgtttttagtgactttgttagcggatgtggtggaagtagcagtagcgaccaagttcggcgaaatggttacgggaaccgcactttgcgtgtgtattagcggcgaatataatagccgcggcttgattgtagcagttgtagctggggagtggtgcgcatgcgagggcatcatccagtccatatccataccttccaccagctcaaaggcgcggtctaggtcgtccaacgcgagactgtcttgttcattttcattctcgttcccattctcactgctgttgtggttctcttgactgttcagctcgtcgttttgctcgttgaagtcctcgcgcccatcatgccgtttcgtgtttacggtgataaagtctccgactttatcaagaatgctgctcttgggctctagatcgtccacaaaaccgtgtattccctcagaagttgtacggcccatgactttctgctactcttgttctgtctcctttgctcatctcttctcttctggtccttccgaagcatgacttcttccctggttatatacatttttctatggtcaagactcatttgccaaatatttccgtgcgagcggccgggtcagcctttcgcctaccacatattaggcgaggacaaaaaaaaaaaaatagaaaacgagaaaatcgcacttgcagcataggaaatacttgcacacagacatacacatacacaccgtacgcaaagaaggcaaggcagcaagaaaaactgtgggaacgtagaaatgaacgtacctacggcgccaactcccaacaaacatttgaacatacctgatttgaggttcgagaaagtgttcaagaaagctttacacagggaattggcaccctcatcgtctctctcacggaaggcgggtgtgattacgaaagttgtggttcgcgatgtcctgctcatgcccttattgcagagctttgttttgtcactcgcgctcatgggtgtgaaggaatggttgtcttacatacgcttgaaaggacgaaccctaggtgaccgcattagacagagactttttccgatctaaataatgcatataaccgtatcttttttatatgaacctagttttgctgtataagagccgagaaaaaaatataggaaaatataggaaaatatgcaaaatagaaacacgaatttttttttgttagagaaaaaaagagataagccctgtagggggctcgaacccctaaccttatgattaagagtcatacgcgctaccgattgcgccaacaaggcattttaatctctggctactcggcactaaaagatgcaccacatccgatgtttaggccgcaccataattttttctttttcctgtctctttgtcctttcacattgcacaaaagtagaggaataatggatggatctaggatgtacgtatatatgatattagcggtctgaagagaaaaaaaaaacagcaacaataacatcgcacttgatgatcagaagggcccctaccaccttgcagctcagtcacgacgacgtaacctctctgatcgatgacctgaacgagcagaaactcaagcagcagctgaatatcgagaagacaaaatacttccaaggaaaaaatggcggatcgctgcactccaatacagactttcaggacacatcgcagaatatcgaagacaacaataacgataacgataacgatatcgatgaagatgacgacatgtcatcttacaacgacaaagcagcctcggtagcgcacaccagagtcctcaattccttgcatctgtccaccgacagcaataccgcccacgagacgtccaatgcaaacgacaaccacaaccccttctacatccgcgaggaataatagcatatccgcatacgcacacgcacacgcacacgcgcacgcatccacattcactttcacttataaaatttcttctctctagttttatatacgttgtattagaaatataaaatatgacaatagtacactttgtaggctctttcttttttttttttctttatatatttttttacaatgaccacggtttgtacacctggggctgcaattttgcaatggagtcgccttcgcctacttcctcgccttccttgcctacacgtttcacgccatgtcctgtggccgtattgccgtcttcgtcatcgccctcctggtccttctccactagttgtatgcccgagtctacttgctccgagatcagtaccagtttcttcgacacattcaactcctccagcgacttgttcaggtcaagaatctgtttactcagtgataatcggtcgttcagcatcttttcagattccttcacatatttcagtttttccatctccagttgcgtttctagatcgcacagctttgtaaacttgctctctaatttctccatggtcagcttgactaactcttggattatcgcttggctttcttcaatgtacttttcggagatctctctcgacttatcagagaccttacccaatttgtcgtcgccttgcagtagcgtctggacagcatcattcacgcattccatcaacttcgaaccggacacactaccatcgcggctgtcgccacccttaccattcagcgttgaaccaacaacttctcggatgtagttgtcctcgatcggtaagcttaggaatttttcaatgcagtcttctacacgcttgtgcccacccacgtggtcagcaatcttctcccactggtcttcatacatttcaataccctccagcaatagtagcatctcctggtctgaccagttttttttaaccgagtttccgttgttttctaatctgatgaaatctgaagattgaaagttggcaccgaaatgaccctcttggaaacaacgggagcacaggttggtgtcccgtgcacgcaaattgtggtagcgcacattgattgactcgttaccgcatgtatggcaaatgtaaactttgtgaatctgcctggagtttctactttcgtcttgtaatgcattgaagtcttgtgcagaatcgtaaacgttcttcttgattgtgagattaacgggaaattccttcttgacttgtggttccgctccatctcctccttccacttcttgcttgatcacattctctggtaaaaatggctttaacccctgcggagtgtccagaaccacttggaagtggcccgtaaaacttggcccaataagactgggcttggtcctggggtcaatctgataattgattaagccccatttttccaagaacgcgtgaatcttcactatcgaggcaacatccatggcaacatttcttctcacagcggtaatggtcaaatattcgtacggcgaaagacggtacgtgttgatgataaaatttcttgtgtccttatatgcctttggtgtcttgaaccttgatgaatcgttgaaaaagtcgggattggatcttttttcgatctcgtggatcttcgaaatatcaaaccaagaggcaaacgacggaataatcaccgggtgagtttgctttgccaggaacctaagggccttctcctccagtttctgtgcttcttgctcgtaattgattttcttatgagctacttctgctcccaatgtggcagattcctcctttgcctgttcctgtgctaagtgagggaaagatggcgtgttggtgcttgtggtgggtggctcctcggtcgcttcgtgcgagtctaccatagggacatccttatccttttcagtgtcgctcattatcctggccttctatctactctttgcttctctgctctacccttctctctataaacctcacgaactaattcaatgttgatgaaacttattttttccaacttttttacatcaagcgggtgacaaagagaacgccataattaaattatcatagaaaagagtaacggattaaggaagtatcaaatttggcgatgagatgagcagatgctcaaacgcggcgctgatgactgttgttgaggatgctgttggggccagggtggctgcaaggacgagaaacatgagcaatggcgtcaattaccgggagaaggaagtcaatgacctaacggctgacatctcggattcagattcagatttggattcagaggacaataaacatggcaaaggcgacaatgacactgcccccatatggttacaagatgatgtgcattcagacgaagatattcagctggactcagaggacgattccgatacagaagctgttcaagcccaagtggtggataaattggcaaaagacacgaaatcagagcaaaaatccttggatgatgagctctccgagatggataccaagacggtttctttaaaacttaagaaactaaacgagtttgtaaggcagagtcaggtatattccagtataatcgccgatactttactacaacgatctaatgaagtggctaacgctaatacaaaagataacagcaactctgatgatgaagaacattcttcaaaaaaacgtaaaacaaaaaaaaaatcaataacagatttcttcaaaaaacagaaaaagaacgaagatacaaccacccaaaacggcgcaccagacgatgcagcaataaagcaacctcgcctattgaaaaactgtattttaaaaccttaccaactagaaggtcttaactggctgatcactctttatgaaaatggcctgaacggaattcttgccgatgaaatgggtcttggtaagactgttcaaagtattgctcttttggcgttcatatatgaaatggacacaaagggtccttttctagtgactgcaccattaagcaccctagataattggatgaacgaatttgcagaattcgctcctgatctaccagttctaaaatattatgggaccaatggttataaggaacgttctgccaagttgaaaaatttcttcaaacaacacggcggcacggggattgtcatcacatcatatgaaattattttaagagataccgacttaatcatgagtcaaaattggaaatttttaattgttgatgaaggccaccgtctgaaaaatataaactgtagattgattaaagagttaaaaaaaatcaatacttccaatagactgctactaacagggacgcctttacaaaataacctagctgaattatggtcacttttgaatttcataatgcccgatatctttgccgatttcgagatattcaataaatggtttgacttcgatagcttaaatttaggctccggttccaactctgaagcattgaataagttaatcaacgatgaactacagaaaaatttgatttccaatttacacacaattctgaaaccattccttttgagaagattgaaaaaagttgttttggctaatattctgccgccaaagagagaatatatcataaattgtccgatgacgtctgcacaggaaaaattctataaggctggattgaatggaaagttaaaaaaaactatgttcaaagaattaatcaaagattttttcacattgaacgatgaatatatcggccacgtttctaatcggtccatacgagatttcatcaattataaactatctggtaatgaaacttcaaatacggacaataaaatcaatccaaccttgttgcaaatggacaaactatataagaagaacctgcaaatggaaatttcaaataagaaattgcaaaatatgatgatgcaattgagacaaatcattgactcaacttttttgttttatttcccatatttacacccagaagacttgactttggaaactcttttaaagacgtctgggaaattacaaatcttacaaaaattaatccccccattaatatctgaggggcacaaagtgcttatttattctcagtttgttaacatgctcgatttgatcgaagattggtgtgatttaaattcgttcgcgacatttcgaattgatggttcagtaaacaatgaaacaagaaaggatcaactcgagaagtttaatagctcgaaagataagcataacattttcctattgtccacaagggcggcaggactgggtattaatctagtcggggcagatacagttgtcttgtttgatagtgattggaatccacaggtggatttacaagccatggacaggtgtcaccgtattggccaagaatcaccggttatagtatataggttgtgttgtgataacaccattgaacatgttatattgaccagagcggccaataagcgaaatttggaaagaatggttatccagatgggaaaattcaataacctgaaaaaattggcgttaaatgaaggttcttttttgaaggcaaacaaagcgggtgttaatgtcactaataaggacttagtccaggagttatctatgcttttaatgagcgatgaatccagtataggctttgaaaatgggggacagaaagaaaataaggctactgagggccaactggctgataaggaggttgaagaattgaccaacagatctcttgaagcgtacaaggccaacagagtcgtagatctgccgcacgtcaagctatttgaaacaacctccggtctttaacttggttatcatacaatattgtttttattaaatgtttgtatatatgtacatatacatacctatatattgatcaatgttcttgccgtacaaattcttcctctagttgttcctttagttcacggtttttgaataaagtatccgcagtattcattcgttgcagaaaggtatcttgaatattattttttgtgttctggaaatcagcttttagtttagtaatccattccagtatcaaagtcatatccagatcatgttttaccagacggttcctctcagaaataactttctttttcaattccatgaaacggagccagttggaatgattctcttctatataggcaggatcgtattgatcttccaaatggagacctctgacgtccatatatgccattctttgcgaccattgacttatcattacatcgccccactcttcgtacacttcgacgttttcaagacgaatcgattctgccagtttagccatttcggtaagaaaagaatctaatgaatgaaacagtgacttttcaaagtctaacaaatgtattttataattcttcagtatcgatgtgatagatgatttggtaatgtaagcttccagttcaacttgacccgattcatcaaaatactttattttattttgcacaggatcgaatttagaggtacaattaatatctttgatttttgaatctagaaacactaattgctcattaacggtagtgttaaggtcatcaagattcctagtgatttctatagatttatttcgcacctcggcctcgaacacagactgtatctctgaatccaaaagtgccatcgcactgtgtattttcgaatctatagccttaatccatgcttcatattccatttttaatgattctgcctcgtaagtttccaattctgcatggctattggaaccaatgataatctttgacaaatcctgcaaaatagcagcagtgacgagttgtgagttcccgtggccatcctgtactccatcgaactcgtattctttattttcatcctcaattccgacatcatcctcatcctcatcttcatcctcatcctcattttcattctcatcatcctcataatcctctgtttccgagtctgtctcaaaaatgggtttggtgagcgtgccatcagcgctaaaggagccgtatttcatccaatccgtagaggagttaaatggattctctagtacattcttcacattgtctgtatatggctttaaatagtaccaggcaatccttagatgatttaataaaggtcccaacttggaatgtagcgaacagcagagctcatttagccttagaaaagagaaaatattgtaccaaaagcggtaaaaatatcccataattctcttcaaggatgagttggggtatctttcaatcagtggttttatcgattgtgagtactttccaactaaatagtcagaaaccgctgaaccttcaaccaatttagaatcgaatagtgagccaactgaaaattcagtatgccggcaaatgggctgtaaatctgtggcaaagtttcccagaccattttgctgacagaccagataccttgcaataaacacgcaagccagcaaagcagtcgttactttgaaaacggccttcatgatttttagtaaagaactaaccacctttttcttagttaagaaaaggtcaatcagtaacagaaatatgatagtagcaacacccaaaaaaatgctatctttcaatagtcaaaaaggaagcctcgatgccacacaagtctcttctaaagtactattatgtaattcctgttaaatgatacctgtattgtggcttaaaagggccgaaatgacaacaaaatgagtagggttaatttaatttttaaagagggcatttatctaaaaaatgaaagacaactatagggctggtaactatagaataggtcttagtagggttatcccttcctctagaaaaaaagaaagaaaaataattttaagtggccaattagaaccaaaaccaacagtatcgtggtatcatacgctccaaagcaactagaagaaaggccttatttgaccattggattcagtattttttctccaagtagcggttacaagactgagagactaaagctagatagtgggtttgagtgactatccccttttttcctcctctttttttattattttgattttatttcattttgattttatttcaacacgattaagacacaagcgttacttccctagactatagtctctgccgttcccattctattgatttttggagcagcagtttttacaaaagaaaagaaaaaaaagacgaaaacaacaagccagagtaaagatgtcgttttggccatttggacagaatcttaatcactctaatattaataagatcctagatgaatattttcatgtgctacacgaactggaaaggattaacccaagcgttggtaaagccattcccgctattttcaacaacgttcaggaacgaggtacaagtgactccctagattctattccggaggagtatagtcatggtgatgaagtgaaaacggcacgtggagatcagaagagtcgatttgagaaggatgatcagcaagaacggtatgagaaagaggaagaggaacggagcatgaactctagcgaatcttccactacatctttttcttctgggtcaacttctaaaactgatttagatgaggaggatatcagcaatgctactgctcccatgatggtcaccacaaagaatttggataactcttttattgaaagaatgcttgtagagacagagctactgaacgaattatcgagacaaaacaagacgctacttgacttcatttgctttggatttttctttgataagaaaactaataagaaagtgaataatatggaatatctggtcgaccaactgatggaatgtatctcgaagattaaaaccgccaccacagtggatttgaataacctgatagattatcaagaacagcaacagcttgatgatagctcacaagaggacgtttatgtggaatctgatacggagcaagaagaggagaaagaggacgataataacagcaataacaagaagagacgaaaacgcggaagctcctcgtttggtaacgatgatatcaacaacaatgacgacgacgacgatgcgaatgaggacgatgaatctgcttatttgacaaaggccaccataatatctgaaatcttttccttagacatatggttgattagcgagtcattagttaaaaaccaatcatacttaaacaagatttggtctatcatcaaccagccaaatttcaattctgaaaactctcccttggtacccatattcttaaagattaaccaaaatctgttgttaaccaggcaggatcaatatttaaattttattcgaacggagagaagctttgttgatgatatgttaaagcatgttgatatttccctattgatggattttttcttgaaaataatatccacagataagattgaatcacccacgggaataattgaattagtatatgatcaaaacttgatcagcaaatgcttaagctttctaaataacaaagagtccccagctgacatccaagcatgcgtgggtgatttcttaaaggctctgattgccatttctgctaatgcacccttggatgatatttccattggtccaaactccttgacgagacagctagcatctcccgaatccattgcaaagctagtcgatatcatgatcaaccaaagaggtgccgcattaaataccacagtttcgattgtcattgagctgataaggaaaaacaattcagactacgatcaagttaatcttttaaccactactataaagactcatccaccttcaaatagagatccaatatatttaggctatctacttcggaaattttcaaaccatttgtccgattttttccaaatcattctagatattgaaaatgacgccaacatcccattacatgaaaatcagttgcacgaaaaatttaaacctttaggatttgaaagattcaaagtggtggaattaatcgccgagttactgcattgctctaatatgggattaatgaattccaaaagggcagaaagaatagccagaagaagagataaagtaaggagccagttatcccatcatttacaagatgcattaaacgatctgagtatcgaagaaaaggagcaacttaaaacgaagcactctccaacacgtgacactgatcacgacctaaaaaataacaacggtaaaatagataacgacaataatgataatgatgatgaaagtgactatggcgacgaaatagacgagagcttcgaaattccatacatcaatatgaagcaaaacataaaacttaggaccgaccccacggtcggggacctattcaaaatcaaactatatgatacgcgaattgtttccaaaataatggaactattcttaacacatccttggaacaatttttggcataatgttatattcgacataattcagcaaatcttcaatggaagaatggatttttcctataattccttccttgttttgtctctgtttaacttaaagagctcctatcaatttatgactgatatcgtcatatcagatgaaaaaggaacggatgtttcccgattttctcccgttattagagacccaaattttgatttcaaaataactacagacttcatattaaggggctaccaggattcatataaattttatgagctaaggaaaatgaatttgggatatatgggccatattgtcttgattgccgaagaagtggtcaaattttctaaattgtacaaagtggaactaatatctcccgatattcaagtaattttacaaaccgaagaatggcaatactactccgaagaagtcttaaacgaaacaagaatgatgtactctaaaattcttggcggtggaagttatattgatgatggaaatggtaacatcattccgcagctgcctgacaatactactgtattaactccaaatggtgatgcaagtaataataatgaaatccttgattcagataccgggagtagtaatggaacaagtggtggcggccaattaatcaatgttgagtctctagaagaacagttgtccttatctacagaatctgatttacacaacaagttaagggaaatgttaatcaatagggctcaagaagacgttgataataagaacacggaaaatggggttttcatactggggccgccggaggacaagaacagtaatagtaacattaacaataccaaccataatagtaataatagtaataacaacgataataacgataataatgataatgacaatgataatactcgtaattataatgaagatgctgataatgataatgattatgatcatgaatgatacattgttttgtacttttctttaatttgtatatatatatattaatttatatgtataagtaccatgtagttttctattcattcattcattcatcatgataatattacttcttacgtatcatttacgtgaatagatcactttaccgttaggcaattccattttcttttggcctttctttgcagaacccttttttactttgttccccttttttgtttggttaccatcatactttttactatccgttattatttcttcttttcctgcgctaccaacagatttgccaaacgtcatgttccaaaccgaagcaggtattctccaaaacaaacagttctttactgaaggtttatccaaggtatctggcgaaattagtgtttcacttccatcaggctctacaacatagacatcgctaaaccttacaaccaaacttttaccctcatccttttcatgttgtttaaacgttagttgttttacgcctagtccattggtatcatcctgttgtttacactgactgatgaagttttcaattcttgatctttgagaacgatattgaataatagaaatgatatactgcccaatattaacgactatccaaataaaggccagcaggaaccaagtcttaggcttcattctggaaaaataaaaaccacccttatggaaatcatagtttggaaagccattctgtagataataatcataaatcttacgattagagctgtttgaaagaatttgagtagcgaggtttaacctttcatacaatttacggtatttagggttcttatccggatggtacttcttggatagctttcttaagttttttgtaatctcctttgtactagaattctgcagtttaggtaacttcaagaacttgtagaagttcatatctgggccatatttcgtacttatttcattttgtaattggaaaatttctgtttcaatggtggtaaaagcatatgatagagataccaatcccaggacaaccaacgcaggtttccagtaaccgttcattcttttagtgatcttgtaaccttgattttttgttcgttttctattcttttggtacgtgttattttgaaaatctcatttttttcgtgattattaattttgaatatggaaattaaatatgatttaccttcaaattgggaaataatgtaaatacaacgtcaataaaagtatttgttcggtcacatatatttaactagcattgaggatggcaggtatcaagttgacgcataagctttatcaatattatcaattagccacaagctttttgtatgctgcattattgatacggtggctgatattaatgccactggtagggtctcggtttttaccgggaggaatccacgaattcttgatatatttgatgttttgttccagcatcatggaagttatttggttgcttagattccacgggttcaaatatggtttgctttcaagaacgtttttgaaagacctagattttatctatttagtcagcgtgatccatttttatgacgattatgagcatgcattgatcctcaagaatgcatcatattctagtttcattatttccttatctttatcacaggcatattgccattggtgcaaactttttaaacgtaagggcgtaaaggaaagaacacttgtatggaaggttaacacatttgttacattgccaattctctacctgagtgaatttgcattgctactattaaatatccaggttaagaactatcattctaccccgactttggacataatcaacagggtggttttactagcatacttccctgtactactaacagcatacaaaaaactattaacaaaatgagcaatcttattggtttaatacatatgtatacacatatacatatctgtacatactcataaatatctggatagttcgtcagccatttcatttgcaaaagcatcagcttcactactattctcgatagacttatattttagccttgcactttgcaaattcctaattatttgttcgaggggcatttcattaggaatttcctcccttattttagtagccggttgaacttcacaatttaaccagtcgtgggtatctataatctcctggatcctatcaagccccaatttttctccatagtcgttatgattaacagttggttttgaccttttccagtttacgaattcgatgacgtttgtaaaggcattgctccatatctcattcagttcatcaatttcatcttgctcgacttcttcgttcacattgaccaacacaacaaaagtatttcgatgggcagctatcatgaattggtgcagcagttcttgaggttttgtttgccggatgtccgttattaagataattcctgccatgacatttctaagcggttcacattcaggcgttataaattcttccacccatactggtatgtctttgcaagagtcaatataaagatcaaaatggactttatagtatctattttcccaggtttggtccttaactatactgatgcccgtgctagagcaatgaaacaggtcttgcaaaaattgtgtttttaaaaagttgtgtgggtgatctgataaaaccaatattttattctgggggtattgaagaaccattgtagattggtattcttgcgtatatacacttgctatcttgctgcatcagattttctctataaagagttttctgtttttcctctcttttcagaattcgaataggaatgagtaaacttgaatgacatggaatttacacatatatacacatatataaataaaatgacttagttttctggcgattcagagtaatattgcaagtaagcagccatcgtcttcataccaccaacaaaatttgaaatatctaacttttcattgattgaatgagcaccatcatcgcctctacccattggcagcaataagacactagtgttcaaggcatcttggaaagtcaaagtgataggaatggaaccaccttccctggtaaaatcaggatcgacaccatagaccagttttgtggcctttttagcagcagtaaattgggcgttgaatggatcagaaacccaataagcaccatcatggatcaattctgttctgcacttgtttggagagttcaaggacttgaatttggcatcacaatgcttctggaccaaagaggtcagtttctcagaatccatgtcggggacggttctaatggaaaacttaccgaagaccttagctggaatgacagtctttgcaccttgagcggaaaaggcgccttccacaccatgaatggacaacgaaggatacctccatctgtgcatcaagatgtcttccttcttgtcgtacaaacttgtcttagagccagttgcagcgttcaattcttcgacgctaaattcgatatccttgtatagagccttctccttttcggttagaggagcaaccatttcgtcaataccgtcaatcaggatcttacccttagaatccacaagggaaccgagaacttgcattaaatcgatcattggttcagcaacaacaccaccaaagataccagagtgtaaatctgcacttggaccctcaatgatggtttgatagtagttgcaacctcttagaccataagtcaaaacaggcttcttagtgcctagccagtaattatcggaaatacaaacggcatctacacctttaaagtaaccattagcttcctttttaatcaattcatccaatttcaaagaaccactttcctccattccttcgaaacaagtaactaagttaacggggaattcttgtccggaggctttgaaggcgtccacaacgttaatccaagataataagggaccagtgtcatcggtgacaccccttcctttcatgatacctttagcctcatcaatgacaagcttgaatggctcagtatcccaaccatcttccaattgagcaggttgcacatcatagtgaccgtaaaccaacacagtcttttttgaagggtcgctgccgaacctagacagaatcacaggaggtagagacagatttggcgtagaaattggtggaggttgaatgcccagatccaccattttaatgtcatggaaccccgattgtgataattgctcggagataaacttggccttatcgaagactttggaccttagtgattcatccgaagaaacagcggggatttgaatagccttagtcagtctgctgaagaactgaggctttaaagaatcaatcttttggaaaacggaagtaagtgagtgagacatgcttgtgtacgatgctctggagcaactgaactaacaatgaagggagattcaattgataagaacaacatgttgctattatagtctctcttttttttttgacacattttcttgtagccgttttgaatgacgaatataagggatattgctaaaatatgctgtggcattggtcaacttaaaagaatacgaatacttattctaaaagatgtgctcgagtatttaacccaccgattggcgcacaaaatgtgttgtggagttatcaatcactcgagggatttaatcgacttcttgtttagttcgccttcgctagtcataataaaatcgacttattaatccaaaaatttcaaactttcttgtcaacataacttctggaaagggtgtcagaggtttttccttcttgcgtctgctgattttattaggttgtttaatttaaagggctttgaacagaagtgggaacttcttccgccttattaagctatttttcaatcgaatataattgaaaaagtaattgctctcacaggtagtcgaatcgtaaaaaaagggcagtaagaacagcacccgacatggctaaccaggtaagtagtaaactgtttcgttccaagacgctaatgctattttattaacgctctcttttttctcgtttgcagaactctgacctttacaagcaaatcactgccggcagtgtagctgctgtgtttcaaacgacaatgacatacccatttgagtacttaaagactggtttacaattgcaaccgaagggtaccgctttcgaaatcattttacctcagattaagtcgtactttgttggctgctctgccctaaacgtggccgcatttggtaagactattttaaggttcgttacgttcgacaagttatgccactccctgaataataacattgataataatgataattttcaaagactgactggttataaccttttgatcgctggtacgttgacaggaatagtagaaagtttgtttattatcccttttgaaaacataaaaaccacccttatccaatcggcgatgatcgatcataaaaaattagagaagaatcaacctgtagttaacgcaaaggcaacctttcacaaggtggcgactaaatctactcctgtggctcgtatcgagaaactacttccagcggtaaaacacatgtatcaaacaagaggccctgctgcgttcgtccagggaacaacagccaccatatttaggcagatagctaacacctctattcaatttactgcatacacagcatttaaacggttgttacaagcaagaaacgacaaggcatcctcagtaataacggggttagccacatcttttacactcgtggcaatgactcagcccattgacgtcgtaaaaacaaggatgatgagtcaaaatgccaaaactgaatataaaaatacgttaaattgcatgtatagaatatttgttcaagaaggcatggccacattctggaagggctccatctttaggtttatgaaagtcggtatttcaggaggcttaacgttcactgtttatgaacaggttagtttgttactaggcttctcttccaggtcttgataattttgtggatcttttactcttttctgtacataaattgccactatttaattattttctctacggtatcttttttagaacaaataactttcaattcttgattgaagttctaagggaagcaattcgtgcgcgagctcaaacatatcatcaacgttattgataatacccatatcgataaacgaatctaccaattcctgtttttgtaacgtgccgattttttgtttcaagaaatccattatatttaaagattcctcctgtatagtagaccacgtttgtttcggcaatattatcctattctcattcaaaaattgccttgtaagatgttttagatccattatttgcagcggttttatagaagaacgtctcaccgcagggacatttaaacggataggatcgttgcctatatcatccaaattttcgtcactggtgttttcaaacgaataatcttcgttttctgcttcttctgtctcctctttatcgtcgcttggtaaatcttcagatagtggttcttcctgttgcgttatggaaattggtaccggatcacgtactggcggttcatctacctgatccattccaatgcttggcgacgtgcgcaaaacttccatagagatactgttagctttatctggagagtgcactgtcaattcatcctcgtgtcctgtcgtgggaacatcttgtattattatcgggtcaatcttcctacttttcaagcctttgtctctttcctgcaattttgcaaatactgtttgcgataaggaagtataatcaggttgcgtttcattgccaatgttgttatctgtcagtttctcacttctgctccgaagaagctcattctcctctggttggctctcttcgtacgctaattcatctattagattccgtgcttgagttttattagtagttgtatcgttgccttgtgatttgcgtgctaacacttggcttaagtcttgtaaaaaacttcgtacttcgttcggatctttattgaggatgtcatgagacttagtagaagcagataaaagttttctataacctggcgtatttctgatcagtacctcatccttgagacgttgttcttcaagggctctctcccgaaagggggttctgatctctgagacttctgtattctcgttgttaccggcggccttcctgggagtgctcattattcatttcttatttcgttactaatcgtcgtgtgtgtcattaatcggtaacgcgtagcttcttaatcttatttagaatatgtaaataaaaaaaagtaaaaatcgaagcctaagcattttcaatgagccagtttcaatgagaaatcaatcactggtgtgccttgatgaatgctactagtgctgtaaatgtcaatgtcatcgcacaaatactcctcgaggttgtccaaattcaagcctccactacattccaagaggaaatgctttttaccattccatttgttcttaagactttgggcgcacattttcaaaccgtcacctttgaaattatccaacatgataacgtctgcaccagcttcaatggcctctgtggcttcatcttcactcaaacactccacttcgatcttcacagcaaacccgcacacggccctggcgttcttaactgcgtttgttatagaaccagtagcccaaatatgattatctttgagcatgaccatagaggaaaggtcgtatctgtgcgtgtcgcagccacctacaagcatggaatacttttctaatctacgtaaacctggtgtagtctttcttgtccccgcaatggtccccttgtaaccagtcgaacgcgccaaactgattatcttatgtgaggcggtggcaattccactacttctactaaggatgttcaaggcggttctttcagctaatagaatgtttttagcgggcccagtaattttagctacaacaatcttaccagagtcattcttcgaaggctccaagaaggagccttccttaaacaaccactcaacttgcaattcgcactgattaaagacttcttgcgcaaaggggacaccacacagcataccatcctgcttacagtacaaattggcctcctttaggtcggaaccaacaacatatccaccaaaatcaaaagaaggaacgtcctcgctcagccaattggtgacgtcttgtctccatgctccattaacgggcaataagtgttcataaacaggcatttttttttttggtgtgtgttctttctgaggattgcgttctttttgttgcgttattaagtggtgtctttaattttcgaatttatggcccaagatatacgaaaactgcggtaggagtcatgataaatgggggctcttcaaccaaccggcgtcaccaaaagcaaaaatatcctggagcgaaatatcacattgtttgtaaccaagcttgtacctttgacaagttaacttacgtcttgccggggtttgctactacgcattcaagtatataaaacgttgtgacacacaagttgatagaaacctcaggatgtataactacaattctagtttccatctcattagtcccaaatgacaataaaaaaaattactggccatggaagatgacaagccgaatattagctccttcgatcgaactgtgcgtggagaagaagctactactatttaataattagtatcccgtgattttgagctgtcgctggcattatgtacctgacattaggtatttaggaaaggtagggtagatcagtttagtacctcaatgggtgcggaaggttaatcttgaaaaatttgcgattagtagacaagtttattctcacaagaacaaaatattcagttcatttcagatatgatcgtgaaggtggaaatcttttttttaaaaatgagaagtgtgcccaacaaagaagtaaaagacaagttagctttctgtcatgcttgaaaactttatggaagcctgtgcattggcattagaggcatctccgacaatcagaagaacacttcttgttattataattacccatatattttttttttttcaaattgactactaggaaaaagtgacaatttatagtaaaactggctagaaaaacctacaagaaaaacaaaaccaggttaggcatacattaatacaagattatatcaatcggaagttcgtatgcaaaattgcatatggagcaaaggaaaggacttccatttaagacgacagtatgagttataaggctaaccaaccatctcctggggagatgccgaaaaggtcaccttccatcctggtgacagatgcaagaacatccaagaatagaatgagtgcaccgttcgctggacacgctgctggtagtaggaagaatatggaaaacgcaggagttacgaagtctcaaggagttcgctcttccgctattggcccttctccgctgcagagttttactcatccaagaaggcgatcgtctggcaggtttagcgatatatccatagataatattctttctgataattcagatattccctctgccagaagagaggaaaggctatccagctcttcaagcgataggcctcgccaatatgagcggttaagttcgcgtagaaagatgatcaatcccctgcctccaagaacatcgaagacgtcacaaaagttagtgttgataccggaagacgacaacttgaaccactttcaaactctaccaacgaacgcgctggataggcaaagaccgaaagtgggctctatgaagtctaattccttcgatcggctacctcgatactcaaaagaaaagtccatggcaagaatcaccgcatataatgttgctgatggcttcaatctcaaccaattgtataagtttctgcaggaaactcatgaggtttcaccaagattgtatgatgagtgtctatacgttgcgtatactttgccacttctaccaggtaaaggcggttttagaatcaaatcaaatttatctaagaaaacaatgggtggaaagacattaattgataatttaattgatacaagcgaacagagagatcatcattatgaatattactcaggtgtggaaactgtggaagatgcaaataataattacgaactagaaaccagtggaaataacaataacgctaatcaagacaccacaacagttcccgatcatctaccaaatccagttggtcagcaagactcttttaatcctatggaaccacaattttttgcggaagaaactcccttagagatagagaaacgggaaaggacagaaagaataaacatgctgaagaaggaggaaaacgacagtgatgcaagttgtggcaacgataataataataaaaataatgataagagtaaactttatgctgttgagggaaacgatcagtatgtacagtcctctcgttcaccagcttcgccatcatcaatatctacgccatcgccaccatcttcatcacagaatgattttgatcgtgtatataaaatgcatagggacaacgaccatgaaggcaatgatagacatgcagaaattttcatttttcactatggcgttattgttttttggaactttactgaaattcaagagaaaaatattcttggtgatataacatttgcagattataagaatttaatgatccggccgctggatgaacaagatattgaaactgaacaattccatttcgaatatgacagagataccgagagaccgagaattttcaatgatattgtcacattacgttcaggtgaccacattatcgagctgacactatcacatgcgattgcgcaatcttcgaaattatcaaggtttgaatccagaatttcgccgattttaatatcagtcacaaaactacctaaaagactagcattatatggtacccttgggttaaaaagggaacagcttttgaaaaaatcagggaagctctttaaattgagagtggatgttaacctttcatccaccatattggatacacccgagtttttttggtcgttcgaaccaagtttgcatccactgtacgtggcaatgagggagtatttagaaattgaccaaagagtacaagtattaaatgatcgttgcaaagttttcttggaattctttgatatatgcgttgactctgttgctgaaagaaacatggctcgtgttacatggtggtttattcttgtcattttatttggagttatattttcattaacagagattttcgttcgttatgtaattattcatcgtcatacttctacatagatattcatacacccttctagacggcattaaaaataaattaatgatatatttagttatcaaggtttttagtcatatatttcaccgttattaccattcttggtcacgtgcaagtaaaaccactcgttgattggctcccctcaagattgcattaaaagtacaataatatgactaagggactcgaatatgtaaattcatctttcgcatcaacaaaggagaaaaagacgatagtgaagactaatattttagccagattgcagtgtttcagtgatcttaaaagtctttttcatttctagccgcattgaattctttaaagcaaaccattaaggagtacttccccaggtttttaaccgataataagagtaagataaaagtacaagaagacagggaaatgattgctacacctataagattagcaaagagtgcatatgagccgatgataaaattcgtcggtacaaggcatcccttagtgaagcatgcaactgaggtcgttgttcatccttgcgctaccaacggaatgttacctggcagcaaagagtgtattccagtgagtaaattcatggaaaattataaaccattccgtgtagtgccaataaagcatagcgctaatgctggtctcagctcgtcaaagacctctgtattcgttaacaggccattgcaaaaagatgagcttgcttccattttcgagctacctgctaggtttcggtacaaacctattaacgagcatgaattggagagcataaatagcggtggtgcatggtgaaggatagatgcagtaatattatgatttttttttgttattttatagtttctttacacatatcattatatctatgtaaaaacgtagttacttaggaagagagaagagtgatgatattatgaattgaaaaataaaaataaaatgagtatttaatgaaggtgggataaaactcttctaaattttttgagtaccgtagcctttaatatccttggcgaagtcccatttcatgttttcaacttgcaagtttttcttgaaagttaaacctgtgttcttatcaattatggccagtgagaagtttctagaagaacgggcatctctataataaagaactctcattgcatttacgatcgcctcttcagcaacctgtacagtggtctttggaatatcagattctcgatctacaactttccttaacagtgggtttgccatgtgtgccccaaaacctgtggccaaggtgggagacgaatacgtaacacctagaagatttacgtatcttaggaattgatcaccattagactgtacaccagcaacaatgatggcattccaaagtggattcatctttgatcttcgctggtacatgacggtagctagatattcaaaaatatagctgggttcgagcgcttcttcagcatccgctagaggattgtcatacgcattttcagtgactagatctttcaataatctctcaatgtgttgcatatcagaaatatcacctgaaatgcccacaacggtgttatcacccacgggaataagcctctccacgccattgaatcttagaagagagccatatgaacctaaattatctgctgcaatgataaccccattatcatatttcattgatatgacggaagtacctgttactattggttgctgtgtattaaccatgggagaggcgcctgcgttcgcaatttgtgtattgtaagcaccataagtagagtctgcgggcctgccccaactgaaaggatcgtgattcattcgtgtgggtttttatgttgttttcggcggaagatgaaggattcctgctgcttatcccctttcttaacttagctgtactttactatgtgggtacgtatttaaggtggcaaattctaaaccaagaagctggaacatctttaataaaaaggattgacgggtaaccctaaaaggaaaaataataaagaataagagtaagttaaactatatatatagaaggacgaaagaaaagatacctcgatttttatttatttagtttgtgtatataacttaagtattttatatgtgaatgtaacgtactattggacaagatattcatctgatttcaaagaggtgatgacgtcgtaagggagctcttgatcgtggtcattggccatgacaacagattgtatggccataccggtgaaactcttagctaatttatccctcgtggactcttggaaggaaacggtcattgggtacaatgcatcttcatatggagcttcgatagtgaatgctagcgcacctgcatcgttggcagcaattttgctaatcttaatggaggttcccatttcttggtccatgttgacaacttcagcgtcagagcatgtagaagactctgtatttatgtctactggctcctgagggaaaactggaatggtgaagatcacatcagcgagttctgtttccaggacgctctcatactcaataatgacatcaaagccctgttgtgattcggagggggaaacccatgtagttagagttaatggaattaatgagtcatcttctgcgggagcgactttacgccatcttagaacacccaggctttggtcgttggctgggaaagccttagatttatcacgcagggagataagtttagtggataggaacgattgtttatctatgtttggatgggtcttaaactggaaggatttatcgcgaacgtcaatagaatcagctagttttaggttcgagtgagataagtcatggtcattaattcttagttctaaaacacctttcaattcagaagagtgaatggtaccatctctggagaattctgcattgattacctccttgatagagatcaaaataccattgttctctgggacatcctcctccggaggaggtggagtgccagaagaggctgaagaaattgcacttggccgtggtgcggcacccgctcttcttccggcaccaccacccaatttcataccgccagtagcagaatgtcccgcacgctgagacgtagccattggggaggccactggggccacctcagcagcagcggcatgggaactttgtagataagactgttgtgctgcaggagaagcatgggagtagtaactgttgatggcgtttgtaacgttaggatctttacttcccatgaacctattggcgccgtcgtaatcgccatttgaagacataaacccgtgtttcctttcatgttcttttctagcaatttccttagcacggcgcttcctctcctcagtagcttcgatctctttattacgctcaataatttcctggattctttcttcgtgcgactccatagacaagtatgtttgcacttgagtaaaggacaagttctctttgtacccgcccattgacacgatttcgtcgaacgaggacaagatctcaaaggcattgtgaaaaatctcttggtcttggaaactagacaagtaggagttgatcgtctgtgaaaacagatttaatgtggccaaatccttgataatattggactggcggtttgtgataagaataatgtagtagttatcaaagggcctatacacgtagcggacgtgcttgtcctcgacaaatgtgtggtctgacgagatctcggagactaggttctggaaattggacagcaactctaggactcgatccttggacagatctttgaattgcctggacaagagaggtttcccctgacgcgtagtgatagaagcagccaaaaccaccattgtgtatttcttttgatggagctataggtattctaatatgatctatattcgacgctgaggctaattgcccttgttcttgaggtgtcaacaaccagattttctaatttttcgctggctgttgctggaaaaatgtaaacgcgcagggcgggtaataataaaagttgaactatgaagaacaatagaaacgccaaggtttactgacagagacatgttttaattcaagtgatgaggcggaaacgtgcaagatcctaaatgaaggataaaaagagttcttaaaaagggaagtaaggaataacagagtagaaaaaccgaaaagacaacttaacaaatcggcaacacttttatggggccccgctcgcctgtgtgcaagtagtattcgacctggaacacgcatttaccacgagaagacagcaatagtccgtacaacattaattagtttcgacaattgctcgcctttataagccatgctagtgcccaatcaaacactttacttgccctgaagttccttttttcgctagcctgtaacttaaataagccatctaaccttttttttctaaaaattttctttattaccctgtcggcttattttctattctacacattatttgccacccattgaaattgtagcttgtattaatagggaaaagccggaagtataaccggtggaaagtactattgaagtgagataagaagccatcgtaatgccctcgttagccgaattgaccaagtcgttaagcatagcctttgaaaacggcgattatgccgcgtgtgagaagctcttgccccctatcaagatcgaacttatcaagaataaccttttaatacctgacttatccattcaaaatgacatctatttgaatgatttgatgattactaaaaggatcctggaagtaggtgcccttgctagcatccaaactttcaattttgacagcttcgagaattacttcaaccaattgaagccttactactttagcaacaatcataaattatctgaatctgacaagaaatcgaagctgataagtctgtatttgttgaacttattgtctcagaataacacaaccaagtttcactcggaattgcagtatctagataaacatatcaagaacttggaagacgattcacttttgtcttaccctatcaaactagacagatggctcatggaagggtcgtaccagaaagcatgggatcttctgcaatctgggtcgcagaatatatcagaattcgactcttttaccgatatcctaaaatcagctataagagacgaaattgctaaaaataccgagctatcctacgactttctccctctctccaacataaaggctttgctctttttcaacaacgaaaaagaaactgaaaaatttgcactagagagaaactggcctattgtcaactcgaaagtttacttcaataaccaatcaaaggagaaagctgattacgaagatgaaatgatgcatgaagaagaccaaaagacaaacattatcgaaaaagcaatggattatgccataagtattgaaaatattgtgtaatatttgtatatataatatgtgcacaaaattactacaaaataaacaactttttctctcccggagaacaaagtaagtggaaaaaattatactaataacaatctaaaaatgtttattagctaggattatacacataaatatatatatatgtgtgtgtctatatttacatatactagaccgcaaaaaaaacataagggcatcactcataagaataataatattaagggagggaaaaacacatttatatttcattacatttttttcattaagcgccaatgataccaagagacttaccttcggcaattcttttttcggacaatgcagcaataacagcagcacctgcacctgaaccatcctcagctggaacaatcgtaattggatctttgcttgcgtcaccagtccatccatagatatctctcaaacccttagcggcggcttccttgaaacctgggtatttgttatagacagaaccgtcagcggcaatgtgaccagtcttgtaacctctcttttggcaaatagcggcaataccacaaacagctaatctagcagctctggtaccgatcaattcacaaagtcttctaatcaacttacgttctggcagagtggtcttgacaccaaagtccttttggaagatgtcatcagtatcttccaagttttcaaatggatcatcctcgattcttgctgggtaggaggtatccatgatgtatggttgtttcaacttgcttagatcttgatccttcaacatcaagcccttctcgtttaattcaagtaacactagacgcaacaattcacccaagtagtaaccggaggtcatcttttcaaaagcttgttgaccaggtcttggagattgttcgtcgacagcaacatcgtacttggttcttggcaagaccaaatgttcattatcgaaggaaccatattcacaattgatagccattggagagttacttggaatatcgtctgctaatttgccctccaacttttcgatatcggaaacaacatcatagaaagcaccgttgacaccagtaccgaaaatcacacccatcttagtctctgggtcagtgtagtatgaggcaattaaagtaccaacagtatcattaatcaatgctacaatttcaataggcaactctctcttggaaatttcgttttgtagcaatgggacgacatcgtggccttcgacatttggaatatcgaaacccttggtccatctttgcaaaataccttcgttaatcttgttttgggaagctgggtacgagaaggtgaaacctaatggtaaggtgtccttggtgtttagcaattcttgctcgaccataaagtccttcaaagagtcggcaataaaggaccataactcctcttggtgcttagtggttctcatgtcatgtggtagtttatacttggattgagtggtgtcaaaggtatggttaccgctcaacttgaccaacacgactcttaagttagtaccacccaaatcaatggccaaatagttaccagattctttacctgttgggaattccatgacccaaccgggaatcattggaatgttacctcccttctttgtcaaacctttattcaattcgtcgataaagtgcttaacaacctttctcaaggtctcgctgtcaactgtaaacatatcttccaactgatgaatttcatccatcaattccttgggcacatcagccatggaaccctttctagcctgtggtttctttggacctaaatgaaccatcttattttttcagtattctaattgagttgtttgggtgagtttgattaaaagaaaagaattctaattgagtattgcaagccacaattgtttcttattgctcttctgctatatattgcgctaagagaaagagaagaatacaagatgaaggaacggtagaatattcccaaggaagtgaaaccgattgcttatatacgaaatattcctctttaaagaaaaggaggaaacagaagcagttgagaacaatctttgttgcgttcacttgttactattcctctcaacggtcctaaggtaccaaaatccggggggagaaagaaactttttcttttcatcaaccccttaaaaaaaaatgcatagttcttaggtcttccattttttcttttgttggtttttgcaaccagagtatttttcctggttgctccagtaaggtatttcgctatcttccaacaaacggggcacacgtgcgggagtttcaaaggggcagaatagtggggttcaggggcataagaagctcacacaatgcggaaaaacaaaaggggactgccattcttcctgaaacccacgcgtcactgctatactgagatctggccaggggcaaccagtatacttagtggataaacgacaggaacacgtactccttaaaagcgtctaaatcttcatttttccggtttatttccaaccgggaaataaattattcctaataaaatttccggggtttgcaggatgcggggtaaaagtaaaaaaatgaaaaagatgtaaaaagaaaagttcgaggtaagaccaggtgcaaggagaatactgggcgccaatgcttttactgcagcgaagaaaaattctaaccgtctgtttcggttgctaatttttgtcttactttcgatggttaggcttcgtggggtaaaagtcgagcttgttttctgaagcggaaattacagcagtttgctaggtgagttttaactttcctagttgcatcccatggtctagataatcaccccaccccacgccattctttttttgcaacacgggctttgttcctgaaacaactggcatggaagatattccggggttgtttaacaataaacgtgtagagtacaggtagaatataggcgaagccgcggtgagcacggaatcgcgcatggaagaaaacacaccaggtaagcctttggaacgccatgtgtaaggtgcaatgcacatgagtgattgttaaaaacagaaaagtaaaaattccgatcttgtctggaggatcaatcgtcctctcagtgcgttttcttggcgagacaattcaattcgctttatgctctttttttttgtgaatttagccaattccggaaaaaacataaaaaaatggttatgcattctttattttgaagaatgaactagatatacagtaatatactaaattgtcagctctcggcataattcaatggccggaaagtagtactattaaaaagaagtgcgctcaaagaataactccgggaataggtgatgtagcttttggtgctggaagcgaaccgctttcatgtgttttggtcccggctgtagtgttctgcggagttgcactggtgctgttggtagagattacgattttggtaaatcctggtgtgacggctacatcagtacctctagttagaccaaacactaattcaatgccaaaacttagacgcccgatgatattccttgtatatatattattatccgctatgggcacagaagtatgtttaacagtagcagaagcgacttatgtatggatgtccaacaacgaagatgccacaaacgtcttcgtagttttatccacggcgccaggtctggagaatggacaccagggtactaaaatcattaattgctcttccaccatcctaacgttgttgacatttagtgtagatacttggtgaaatatgtgcttgtgaaagcgattgtccattctttatatatagtcatgaaagtagttaaagtgaagaatatattagaagctttgggttcaaaagaggacggtgaagtggctcgctttgttaatatattgatttatccgaaacccgggaagcactctagaactatgccttagcattttagtggtcgaactagccagtttttcgattgttggatgtgttgtaatgacggtattatttttgctcaatgagttaaaaggcgaaagcgtcaaattgtaggtcagaatatgactgacagaatcaaactgtctgacaattgcacaggaggattggccggagtaaaatcgtttaaggtagtataagcaggttgagcagacaattggctagagctagccattgagcctaaagaattgcgaacaagtcggataagacaaagggaactaatgtacaagatcttgtatcctgagaagaggaaataagtactcaagaatgggccagaaataatgttagagtttataggggtgacagcccttgagctaataaatactacaataacagtgtccgtttgaatgctggtcggtgaatcaatcaaagatttggttgcaatgatatgtgcaattttgctgatggagcttgctaaagttgtgatattagtcgagatccaattagaacggattaggcgggaatcgcttgagggatcgccaaaaatacttgtgatttgtgtaagttggttgtaatgcaaacctgctatctttactttcgaacaaaatagatgaatcagcggctaagtattctgtggctaatgtgctagatacatgttgagtactgctatttgtgcgcaaccgttctaacaatgctgagagatgatgaattgaatatatcagaagttttactagctacagtagttgaggtaccaatagtgggggtatgcgaaaatttactaaaagcactgactggagttgtggtactagtgaatacctggtccaaataggttatgaaggaatcatttgagaattggctagaagcaactaaaacgcccgtggattgaggttcagatttgctactgtcgctttcgaagaagctagatgaaccacgggtaaagtattctgcatctaatgtgttcaataaatattgagtgacgttatcgtaatgttacagtactaacaccgctagaaaatgctggtgtgaatgtgaatgacgatagacggactgatgcacttttccattgtacgataacattacttacaagattgggagaagcatgattgaaaatttgactggaagaaccacttatattaggagtggcggtattagtagaaaattgactaaacgcatccgaaaattaaatagaatttaaagtttccttgggtgcactgttttgggctgcagtgctaaaatccagaagtgttggagtcaggttacttgtttgcatacagacattactgaagttttcagaaggcctttgaatcgagaacgagataaggaagtgtcctctaaatgcaattttagagctcaaagtgaggatagtggcactgaaacttgatttagttaatggcctttagatttgctgctgtctgaaaagctcatcatcgagaagctcacaaaatggagttctagttgccctttcactatacaatcgatgtaaagatggcttataagtatttgaattgtaagttttgtgctagctgaggaatcaaaaaatgtatttagtgcttccttactggtcaattgtgtattatttccagatgaaacagaaaatatgtattttatggattgactaatcaagtcacttgctgattgtgtaatagtggtggttaaagaaagtacagtaagtttgcttgaaatacaggcaggattcctggaatactgcctactactgcttattgaatagagtgtaatctcgccaaacccagtaatagcatcgtttaagaaatggtgcttacttgtaggtaaaacttctgaaggatactgagtaaatgtaaaattatatgagttaaggcagaatgactgtaaacttttgtgacgaatctggaagatgcattcgtcgattggccttcattaagtgaagattggtaacctattgcatccaaaccagaagtaatacaaccagaatgtggagatgaggagccaacaggtgtgtatccagaaggttcagccacaggttggtcatcaataccactgggggagcatgcaatataatcagatggttgcgaggaatagctagtagagctaaaactgaacacattagttaagattagactagccatgctcaaagaaacaattagagaggcacctacatgttcgttatccatttttgaggaaaaaatagaagtgataataataattttgctcgaactactcgtaaagctacttgaaaaacggctcgagattacggaagagtcggtagtaaaccgactctcagtgtcacggaatggaagcgccttgaaactactaatatcaggtatgcattgaggggcaaggcaacctgaatatgcaaagagcatagtcttaactttcgtagtacgtaatacttcggcattaatttggcctaccgctttgccacagttgagtggtcactggagtattagccatgaaaaaatgatcccttgtatatccaggcccaaagtctaaaatgtacttcctgccaatggttgtcacagctaatattccattttgaattgacttgatttttagattattatcatggaaccaagttgatgtcttgcaatttctgatttttaacgatgtactggaggttgacgactaggcaaatctgcgaaacatcctagtacaatggcatttggttctgatgacaaaacaatagtttgttcctccactgaaatgttattcaaatcttcgatataaaaaatgcggtaatttcagacccaaagacatccattacccatcatgctaaattgtgggataagatatatatggttaattgatctgattcagctgcaataatatcggtatttattatggtaccttccatgctctttgccgaactgcagataacctgcgtctgcaaattgcaggaattactgaaaatgaaattgctaaactttgggagctactagaagaaaaatgagtacctctcctacttatatttcccattttcttgaaggtttctccttcccatataagaattccaaacggtgttcctttacaaacccataagggtattaaaatgattctcaaaatttcctactgcactattgttttttctttctaatagatgaatcatccgtacacacacagagaccaccgtttactttcatatcagaatagaagttgtgaaagctacctacgagacttaaataaacatctttttcgatggtgagcttttcatggtaattcgtcgagacagtaactgttttgctcttttctatgatgtctaaagccaaaacaatgtccatcaagactagcgtaataaaaatcaacctgctcattgacaattggattatttttggctgttcaagattaaaacagactcagtaggcaaaaacttcaatcaatagtaccgggaagatgacattccggtctaagtggtattatacacttatagtaaagtcacgtcaacctttgttacttttcttaattgattatatacgcactcttctcaatatttgatttcttcatcgaaaagatctacacgaagtttttatcatgtgttagcgtgatggaaaagatctgtgcacgtttaattagaattgcaaaagcttcaatgggtttgattgagatttttattttcaattcactcatcttgatgttcaccaccaagcctacatcgaaactttgaaatacaggaaagttgcaggaggctttattggttgaattgaaaaagaaaggaagaaaaacgtaatggtaaaataaaactcgactatggcgcaaccgatagagagtttagtggcattagaaattttaaaagaagctttaaactacaaagtgttcttctgaatctgaataaggtcacttacatagaaacctacttacctcaaaagcgtaattccgaaaggcaaaagaaaaacttttgtagaatcttcagctgctagaagttcaaatagaagacaaattacggacttgttgcagtatatgccaagctacagaagaaattatatttcttaatacgtacagaaggtatgaaacgttagtttactcacagaagataccctggcttttcttttattaatacatggagttgcaaaaaacaagggaaaggaaaatcaatcaaattagaattaaggttttttttggacagtgcagcgtcaatgcgcacgtaatggcttcgaagaaaaaaagaaggcaaatacaatgaagctgagatcttgttttatcatgaggggaaataaattggaagcattgaagttgttggaatgaaactctaaaatatcatctgtttagtagtatcgtgttactagtacattatcacatacagtgtaagaaaatgacattaggtatgagaaacagtcatcaaatctaatggaagcgaaattcaagggttggtgatgtaataggataatgaaacatataaaacggaagtaaaaataatcgtaatattacaaggagaccaaacaaacagtcgagagaagcgtatgcacaatcatgcaagaaaaattttctggaagaatttatttaatcttaaattacaaatcttagtagtaatggtcacttctgatagtttcgaaaaaggaaagaggagatgactattgagtcaaatttttttgacggaaacttagcgaccgaaaaatatatatgataataagaaaacgaatggcatacaatgattagtttcaaatatttcacgcgcaaagaaagaattctactaccggagtgtgcccttcttgtactttattatcagactgtgtctctctaattgcgtgttgtccgcggaataatgctctaatttaaaaaatcgacatattctgacttgtatggcgctttgcattggtgtttatatgttaataacccctaatcatactctatatgaatactttcaaatttaccaacacaataaaatcttcatattctcatgcatgttttgccctgtatcactaaataatacatactttaccgaagctggttgtatttcgtgtatatcatagccaatgatgccgttataatgtccgaaatattatcgcttaatgaagggaagcagctaacaaatatgacaaatacagcaatttcttacaccggtaactaatgattatacaaacaagacttgattttttttatggcctgtaagaatatatcataacgtgagttctagatatttaaagttctttatgcatattctagtctacgtatataggagttccaaaaaaaaaaaaattaaatgcacgttattcttgacgctagtgtaagtttttatgtactttacctgctagcttcgtatttctgtcttgggatattcttgtccctattatgagaatgtacaatatgcaaaataaaggtaaaagatttgaaaaagagaaaatacccaaatatcaacaaaactacctctataggacctgtctcatggtcttgacaactttatgcgaaataagaacacgatcgttatatcacttaacgcttgagatatatacagaatgtagtacatgtcggcccttctacggatttattaccatgtgtatactagaattgataccggcaacccatagtgacttttaacagggcaattggatttgcataaaagtatatacagtaataataatatttcctgatgagaaaggtggaaagtatcgagttatgtgtaccttcaataccaatctctacctctcgttaatagtgccacaatgctatggattctaagcaatttaaaccgcatagctattagtgtagacttcccactgtatttgaatgacacgttgccttcattccttgttgcgctgaactttcacgtcagatatatatacataagtgcaatagaggcctaggctaatctgcaaatttctcatagatgtacaccgcctgtgccgtacggcatcgctatcttctgaaaggaaactgtagtaaatttaccaaaatatctccgaataaaaagaagaggaacatcttttaatgaattatagagtacaaaagaatcatttaaaagagagggcgagtgaaaacatgaaaagaaacgttactaacttaattgaccttaaagtagcctcaccagttaagtgcattattgatcattccatgaataaccatttttaaagactaagatgctgagttgtgttatatagagagaaaaaaacgtactttcagtttccatatgaggtggagcgcaggtcataggtatgccggctcattgttttctattttaaaaagtaaaaaatatgctgctaaaggaacacgtgagaaattacattctccctaggtctgcgataacgcggtaatattacactgccgccgccttccatgcctttggaaagcagacaatgatgctaggcggcgcccagcagtataaacttttcttgcttataaccagaacctctatcacaaaattagaaactgcgatactatgggtcagatcgacacatagggagcactattaggcgcaaggcgtatacataggcattgcgtgttcaaaaattgtcgtatgagaaaagttccaaactttccaccattactcaccaacaacttacaccagcccggatttaagatttagcttccgagaatattgtgactcagccactggtctcttgaatgttgcgtgtagcttgattaagattatggcataaccgttttttttacttggcaagagtgaacgtccttttactccaaaaggctcctgatgaaactggagagtctctttgttctgaaatttttaaagtttagcacaccatattcacgctcgaggtgaacccaagttttcctgaaaaatgtgccatgaacctgaaaaaaagaattattctcgaaaataaaaaaggcaatcaagatcggaaagataagcattttttttcaatccgtatctaacattcataaagtgataaaaaaattgataacgattttattgtcgcctcttgttttgagtatatttttttaacgttctttttcggcattcaaattccgtataatcaactcaattgtaaggcgccgtagcatccaaataatgttgaaagtgccaatttgctcatcagtgctaaatattccttgataaaaatatagaagacaaggacatataaaaagaaagactgctctagtgttgggacaccacaatgaaaaaatacttaacgtgtttcgaaactgtgaatataaaattccagcaaaaaccaaaatattcactacaatgattgatcgtaccgagttatcgaagtttggtattactacgcaactgtctgttattggacgtaatccagatgaacaaagtggctttgttaatccacctttgtataaggggtcaaccatcattcttaaaaaacttagtgatttagaacaaaggaaaggaagattttacgggacagcaggttctccaactattgacaatttagaaaatgcctggacgcatttaaccggcggtgctgggacagtgctatcagcttctgggcttggttctatctctttggcgctattggccctttcgaaagctggtgatcatatcttgatgactgatagtgtctacgtgccaacacgtatgctatgtgatggtttattggccaagttcggtgttgaaacggattattatgacccatcaatagggaaggatatagaaaaactagttaagccaaatacaaccgtcattttcctcgaaagcccgggttctgggaccatggaagtacaggatattccagctttggtctctgttgccaaaaagcatgggataaagacaattctagacaacacatgggcaacgccactcttttttgatgctcatgcgcatggtatcgatatttcggtagaagctgggacaaaatatttgggtggtcattcagatcttcttattggtctggcctccgcaaatgaagaatgttggccgctattacggtcaacttatgatgcaatggcaatgttaccaggtgccgaggactgtcaattagcattgcgaggaatgcgtacattgcacttaagattgaaagaggtagaaagaaaagccctggatttggctgcttggctcggaaatcgagatgaggttgaaaaagtgcttcaccccgcctttgaagattgtcccggacatgaatactgggttcgtgactacaaaggttcttcaggcttattttccattgtccttaaaaatgggttcacaagagctggtctggagaaaatggtagaagggatgaaagttttgcaattgggattttcatggggtggctagaaaagcttcaacatggccttacaaaggttttgcactaagaatacaagtgggtctcgaagaatttgaagatttaaaaagggattttgagttaggctttgaacgtctcgcagaagaaatttctttgaatcctttacaaatctgattttttttccttttttttttggatttccaagcaatgttgtttgagaaatgaatgaaatttttgactatagcttgtcttaggcaggctggagtagacaaccatctagtagccaatgtttgcccagttaatatatggttcaattttctagctgtatcatattatggatgatgaagcagataatctttcttttttctgtatgtctgattgtaataaagaggcttaccatattgtgaatgcatttcaatgacactgcataatgaagtcattgtatttagaaaagtaataattttgtattgtataaagatagaaaaaacgtatatcgtacttattcagcggaaatgattctgctttatctacttgcgttcctgaatataatatttgtgaaccaggcttgagcttgacactacagattttttagttcgatttcattcagtagagaaaggcatatcaatatgacatgtgatctcactccgcggctaaatgctagcaataaaaagaataccgtaatagagatgcagcaaaataaccactggtgtttaagaaataatatgattacgtcagtaaccgaagagcccgtacgcactctgctaccatagactatgtatattgttacctattgtaaatagctatggttactctaagtacgtatggtgctatgcatctcggtgaacggatgcaattatgaaagtgtaggtcagaacatcatcggtggttttgtcgtgtaaaaaaggttataaggaaaattatactcacatgattttattcatcatcgtctgtgtatcgcttcaattaacattttgaaaaagagattactttatatgacgttatgtatatctttcaacttaaataaccttagctggcaaaataaagaataagataagggccaagaagaacgctaatactcgttttttttcaactacaaaacaactagttggataattttgaaacaacaaagtagaagttgtacatatatttttgcgcatatggctctgaaatatcgtatttttcaaaagcccgatacaaagccgtcagcaatacccatagttaaagattccttgataacctatagcttccgtagacaacaacacaaatttaccacctacttttaactcacccatgtttttcagtttatcaatgaatctaataaacgtggcttacgtaacagctccgcatggacttgaatttactcctagcgagcctagtgttttaattgcttgcatacaatcttcatcggaaactaaacaggaaatagatggcccctttctgtagtagaagaaatgctgttgctgaaatcctcggacagttcaactcatccatgattgttctagaggttcctagatcagatgaagccttttgtaacaccaatgacttattgacagtgtaagcggtatctggttcaaccgagaagactttcgtattcgatttatgcgacctgtaatatgttatcactccttgagcaaaagaatcagccccacaagggacaaatattaccgcaggatcgaatggtatttcgctacacaaggtagtgtaaccataagaaatccagttaggaatttcatcataacctatgaatgaaaaatcttgaataagttgatttttttgtcggatcgctactacaaaactctaaagaactttttattgcataatcatagttacctttaattttgataacttctgctcccttttctgatctgatgttctcacgctctgttctagaacattccatggagtaaatattgtagactttaagcctaggatttttgccatgtatgcaactgctctaccatcattaccatctgtaacagccgctagcatcaaagacgggtgttggaatttgacaatttgcttcaatgtatccaaggaagttttaggtaatggcaggctaaatcttccaatcaaacagcaaaatacacctcaagacgccccaagaattttgaatgaaggcgagctgaatcccgaactttgttctttaatgtacaatttaataccaaaatgattatccaacttgattagcttcgatgactcatacagatccataccaatatcaacttcacggataactttttcaactcttttaaattcttcaacatcatttttcgatcaaactgcgtcaggttttacatatagatcaagcgttgtcggtttatactacgatgtcatttacgatctgctgccaacagaagaaacattacgcagtaccttggaaaaatctaggcaatttatagacatgaatctcctatcgttcttaaaacaatgtatttcctgtcgttgtctcgattctcttttttgctattctgaaggacaggtccatttatcatccagaattctaatcccgaatttaagatatcgtaacagtaacaacatcatatccaagcaccgaagattcattgctctatattccttgtcttcgaataaggaagataccgcgaagagactctttaggagtcgggcttgactccctgccaaagcagctattcctgtataacacgcgatattttatctccttgtcgtcatgtgaaagtcaaacagcgcacgtttgtttgatgaagcagcaactctcctcttactgcttttgcagaattttgtgagaagctctcttctcttggaactaacctagccatatggctttctgccctctttccgtcaacattacaagataaagatatcggtataatttaaagattcgacctttacgccctacatggctaaaattacaatgccaaaattatcatgaattcactttgttgacccggaattacaatacaatgcttctaaaaagagatttcttttaaatttgtcaagggaagtcatttatctccacacaaacgcacaccgaaatatatatatatatttaaatttcctcattctttgttgacaggttgatttgtaactagaaatcaaataatcgggatgcgcaataccctgtagtagtcgattcaaaaactgattaaaaaatcactgacatttagcataagcgactgaaaaaatgtactgatttcttctcgagtcatatatactattacatgagttcgagtatggtgttgttttctttagaatgtcttatcaagaccgacaattcatacaggtcgagatatgtaaagtctacatgccgagctaggatgagaaaaaaagtatacaaattgcaggcaaataaacacaccaaaagatactaaaaaaatcttttaaagttttggttagttattggggatcatcatgcatttaacgacaacagagaaaagaaaaacaaaaaaaaacaatacaatgtaaaaagcagtactatgtaggaataaatcctgcctcaattgcagaaaaaaaaaggtatgcgtaatctaaataagatactatgtattgatatttcatatcactaacttctctcagatcaaatatgatttaaaggagcgatttctggactgtacaaaaaaaagaaatagactacttacatcctatgaaggtcagagaataaaacgcttttccgttaaaaagatccaccatatggaagaaaaatacgagagttaaaatgctatttaaaagtgctaaaggaatccccagagacctcagctgagataagtaatatcgttgatgaattacaagggaacaatgagcagagggaaaatggacagatcctttcgcattcctacttgtttgatgagttcaaatgtgaaatagtagcaacaaaaggtcataaatcttcaatgatatttggacctactagtgtctatagtaagtgctcggccaagtcaagcggtatcattaaagacaccgccaagcttccaatatcacgagtaaggatcaaagttatgttagagataactgtgagttttttattttttgatcgatttccaagatcattcctcaatcataatctatatgattcaatatgtcctttctttgcgtggcaatatacctcatattatctttctatttacaggcagtcctttctatttcatttcttacaaaaggattttagcaacgacttcgtctcagaagagttaatatatgcactagttgcactaggcgcaaaaaattcctttgacaatagcctttcaaagcatacatatgaatattacaaccactcaaagagaaatttactggaagattcgacaaataaaaattcagctttttcaagtgcaagcgtaacaaagccataatgcctcctatatttagccttttttgatataactgtcggagagttaacaagcggctggactactttctggaatagcgttcggaatgtgttttacttaaggattcgaacgtgatcctaacgagtggatgcacagttcagagttatctaacaatattcgtgaaggatatgtcaaaattggatacgcttatgtttatgatatatcatttatattaatatatagtatgctcacattttcttattgctgaatagttcttttttacgtttagctgagtttaacggtgattattaggtggattttatattagtctacataaaaataagtggtggatatctacataaaattgtcataacgcgtaaactaaaaattatttttatgatcattgaggatctataatcaactatagacattaatgtatggataatcatgaggattataggtaaatggcaagggtaaaaaccagtgaggccatttccgtgtgtagtgatccgaactcagttactattgatggaaatgaggactgggtcatggggcgcaatggagtgaagtaatatatactttagcatacgtgtgcgtacgccatatcaatatgctagtgaggtggtgtgggtgtggtgtggtagtagcattagtgctggagttggtagtcgcattggtactggcattggtagtcgcattagtactagcattggtcctgacgttggtactagcagtggtagtagcattagtactggcattagcactaccatgaatgcacgtgtcgctgtcctcatcactgctgcaatactttctgtacctgtcactgctattgctctcctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgcacttttgtgagccatttatgatactttcatattccccattaaaacaggtactactgttgaaaaggcataataacctgaagtttcgtatgggttagttacactaggtgaaggatcgtttgcctccatatggtcaagccattcgcggacattgataatagctgggacaattctggtttcataaagggtttcattcatccagattacggatacattcaaatagtagtcgccaaatcctgatgcctcatcaaaatgaaaatatgtctctaacggaactgtattagaccatgcgctcagcgtagctgcagtcgcgttggttaaaacgttagctaagcttaccatcgtgttagtagatgatctgttatttcgctaatagataactttacagaagcaccatctcgctaccatttatacgctttggaataaaaatcagcccttgtaaatttcatatgctcgaccgtttaggagattatgcatttttaagtcgttcattaatattactgtagcgaggaagatgattattgatttcgaggggtataatcatatgcggcgtgaaaaataatgacttgggttggaagccgttaggatagtatttatactgtcacgaaatttacaggaagttgtaaatatgttgcctaaaatttttgatagcaaagccaccgactcttcattatggagttttttttctcttattctcctgttgccttcgtactgtaaaccccagtcatgtgaaatgccatatggaggctagaagaatgaaaaatcaatttatattttataatacagtgtcaatattgatcgaaggatgcataatatatacactggattgaccattcgaattatatatctatctattctatacatccgtgtaacttagtaagaaccagacaccaaaattatttttttatagaagatccttcttgtctttcatgtacctctttcagataccactgagtaatatgactttaaaagctctactgatatcatttatgtattaacatgtctgaacaataagtatctttttaactgtataagaaagcatgagaactgtttcaaaaacctctcatttatatatggaaggaaattagagaaatattgttcgtagtgtattccttaaatttacggcaggaagaattaaaaagaaaataattcaagattctctacttaaattaatgcatcctttccattaatagtttataactggcgcgatgcaatacactggaaaaaattaataatagttataagtacgagaaatatctactcctaaaccaaataatgtgacataaagtatacagcaaatatctcttcaagtttaattttgatatggctaaaaaatgcttattcgggatggaagtgaagcaactagcctaccaaacgcaaccattttaaaaaagccaccagcatccattgcataacaagtcacagtctgctataaacgtttcagggcaatgctcacagtgagcacaagcactaacaatttttaaataatgtctaactcaccataggccacactataatggcctgatttccctcaatatatgtggctgttgaatttgcagatcatcaccctgtgcgctttacaagatattccttaatagaacaatctaaattattctatttgaaaaaatgaacaataattaacacgagaatttaaaccatactcggccggattagcgatcatttcgttagtaattaaaattaacatttccatgtgggactccaactgctgcatcgtcaagttgataagccatgaaatcaccaatatcaaagatagcaatccaactggaaaaattattctcggcatatgggtgatgataaaaagcgtagcttaacaaacaccagtgctggttattatctgtaaaatttgattagatttcaagggaaaatctgtttgaaattgcgtttccttgttggcctgccatactttaattgaataaaagctccgtatatgcttcttaaaaataagcaatagatccagctgactcatttcctgtatttctaaggggaaatgcgtagggaagaccaatttcatgacgatagattgaaacggcaatcaacatctgaagaaaagaaagtagtatgacagcttgatgtcttatctcatttactactttaatgacttcgtacaacttcactgagctaatttacgccatttttacgcagattatgatattcatttcttgagatatgaggtcgactggcaatgcctactcttataaagagaaagtttttgaaaacacagtacgtttacaaaacgatatcaatgaaggttgtagctacatgctcttcaccagactaatatatcctcttagtaaagcgctatataatagcaactcaatattttgtaaatacaataaggttaacggcgttattcattttcgtctgatattcatttgcaatttgcagttcaacttttcaatgatgatttagaatgatctaacactggaagttgaagtttttcaaaaatttgctgtaaaatttgaccgatttgtgagattcttcctggctgtcagaatatggggccgtagtatattgtcagacctgttcctttaagaggtgatggtgataggcgttgagtatgtgtagtgtttgacccgagggtatggttttcacaagtactgcgcactgtattgtgaaagcagcttcgaggtgcgtgattaaaaaatgcgaccaagaataaacgggtacatcataacaagggccatttgaattgcatttatcaggatttgtaaccttgttctaaagaggcatcgtatagtttaagttcattttccacccaatttgatgacggtgtggaccttaacctattgtcttgaaatttaggttatctcttagatatcacatgtgattaccccagtgaacgcgtataagcttacagaaaggaaaaccggttggctcagtcaaaactgttgcagatttgggctcccctgaatatttgagacatccctaaaatgaagagatatatacagctaattttgaatgaaaatttataattcgcaatgaacagtactagagatgagcttttgaagtcctttcaaattatttgttcttccagttgatattttttattttatataccagtaccaaatataatcttgccatacatttacctttttgaggttgttcaacggaaatccagtgtatttacacattcttggaaacccatcgcttataatacgaactaatttatttatgaacaaaggctttggaaaagtatccctactttttacgacgctaaatcatgatacgaaactttaggaagattaacagtcactccataaaatcagaaagtattcgctaatagtggaaagaaatggttatataaagatggaaatatcttgaaagagacagtttaacccgaagttctgtcaaagtgtttgatttgaattgaatagtatcacagaatgcgctagctatgtacaaagaatctatcggcaagtaaggggtagcaagctgcttaaagcttcttatcacactgtaacctctgtaaaagcagctgcgttgttcttgcactctgcatgtaaatgacgacggccaatgtaaaaatagcagtcactgcaggcctctcggattgtacccgtaattacagcaattgccattagatttacgaagtcatttaattaaatggtttgatttatctccttaaatgcttccagaaatgggactagacttttttcactcaaacctgttcacaattattgctctttttcaattataaggtaaacaaggccatccatcagcaacacagtgctcgcattttttaattaaactatataaaaccaactatttgtggttgcgacttcactttttgttgaattactacccaatcattaatatcgaagatgtgagatcatagatttattggctttgggcatctcaaatcccaaggggtcattttaaccaacaacattttaaaaagtagatttgtctgcctcagctatgagatgcgcatgtccctagcatctcatatctggctatattatgttttccacttggtgaatgttgaaaaaaacaccactcgtccaatttatcagtttgcaggtctaatgtccttccctgttatttaaactgtatattgtaagcatgtcttatcgaaacaacttactcagttgtccgaaaacaaaactgcaaattctgtgcgtattcacgtactagaatactgtcaaattggatcttgatttaagcttttatagcaacgaactttgcatactaagttttttttgttaagcggaactgccaagaagcattcagtaaaatacatcttcatcatttactgataatacttattcagactcatatcatactatttcgaattcattatacatcctcaaaaaccatattcttcagttgtaataaaagatagagcctgcatttgattcgatttccgtaatttggggggccaagtcctaggttgacttcatcttggatgtctatcgcgatgcatttagtgtggcatagaatttctctcttcacgagcagggaaggaattgtattatattatttggtaatcgcctagtcacagtcatttaaaagaaacttagcattattattccagcatcatgcaccagaacagtaaaatgccatttctaaaagtattctcatagccattaaacgattcaatacttttttggtagcgaagtcaatgcctctctgaatattgtatactatatgaataaagtgatcccataatcagactacccagcacttagtagcgcattttagaactaaatatatattgcctttttaatactgtaacttgagaattcttaataaggaacaacaatggtccagaaggtgttcggtagaaagataaaaacttttaaaacatacactatcaagcaatattatacttgttctttcatcaagaggggattgtacttttatttgatttgaggccgggtatcttgatttcacttatgttatactgtctcttagttgataaattcaatgttacatttgctatctcattttcagatcagcagctatattgaccttgcttacatccagcgcgtgtgaggcactacctttaaaactcttgtgctccttcttcaccatagtctgttatccgtttgttcttacggaggaaactgcaattgaccatttatgaatcttttagtgaaatttagacactattaaaatttaataataggcaaagtacgtcaattatcattcttggttcctgaaaagttgaatctgttatgtagtctgatatttggggttagcattgtatacttcccttgagtaatgcattatccgtaacgccacttttaccatattcaagtgcaggtatatttagcatattttacatataatatactgatctccgaagctaggtgagagaaagcaaaggttttgagggttattttcaccattggaactaagatcgtatacactaattaattctcagtgccggagacgcacgatatatgggctggagcggtcctgactaaagtcctgctggaatattggtgaagtgtctcaaaaaactagtaaggtcaatatcagggaaggaactattattggccgaggcggcagctaggttaaagaatctagccgtcaatgcaacgaaggttatcaagtacattcagttggatacattaaaaaagttgaatacaatatcaattctagaagattgtagcaagtttggtgagatagtttatgcctataatatataagtgctaactcaatgttcagttagtagaatcacagcctgaatattctgtgcattgtttactcagggacagatgcgatctcaatgcagggacgaaaaacagtcttatatgcgcacgccagccaaatcttttttgcggcacctaagatctctcgcatgataaaagcataatatctttgccccacaaagtcaaggcgtattggaaaagctactttagttaataatgaaatgatcgcccatccgggtaaaaatggttacaattccagtgttgattattgttcgtttgtcagagagaataatttagatgctcctattgaagaatatcttgttagcacatagggcaatcatctacgactttaaccgcaactgcgtctgttaccgacattggaggattgtatgctcaaatgacccctgtggtgaagatggacacttcttgcacactatggttgaatcttgacggtaccctcactcagagttttatagtatcacacgacgctactctcccgcttgtacattcattctggctagtttataataacgttaaggaaatgacacccatacctcatataaattcaattggaaataatatttgtaaaagcacgtgatattgccttttcttctatctggttaccaatatgggatcaataactttacttttgaagatcttgtttttccttcagataagaaatcaaaaaaagaatatatgcacaaaacagtatggatataatacaccttactcttggtcgtgattgaaaacgtaaggttctacataaattattgagaaagacttatttgaagatatcgagagtctatcatgccctttgcacaacaaaactaatgtcagcttgcccttgcaacatcgttatactcccagtcgagattttgaagaattcatctaaagatactaagtatagcttgtatacaacaattaatcgaggatatgatgtcccaagactcaaatatggcatcatagttagccctcgagtgcacagccttgagactttattcagtgatctgggctttgacaagaatatagagaaatcctcgctttacttattattaaatgatcctaccttagcataccctaatttccatgaacattttgaacagcttaaaggtgaaacaaacaaagatttatctctgccgacatattatattccgaaggtccagtttttgacggaggcattcgattcagaacataccctagcaaccatcggctacaaaccaaataataaggagagttatgagatcacaggttttacatccatgggtaatggttatggtataaaacttttcaattacagtgtaattcatatgatgcggtctcataagtgtaaaagagtggttgcagatattatcatggagcatgacctattgggttactatgaaaagaagcttggctttgtagaggtgcaaaggttcaaagttctcaaagaacagcaccaagtaaaggtatttgacgataaagttgactttaccaaagactttcatgtgatcaaaatgattaaagagttgggaaatcataaattgtagtggtatagtcccgtacacactcaatttgaataaactgtaggttctgctgagcaacatattaatatagacagtaaaaagaagtgggttccttgttttgctgcaattataactaaccgtgcttactaccaaaaaaaaagtgcgtataaatattcactatttacaaagttgaaggttccggatggatacagaatagggatcctaaatataaacactatatttatttatttttttcgaataaaagtcaagttagcaatatttatgtagttgatcaattgcgattttaacacacatttccaaatgtcattttgcgcttatataataggtgccatctggacactttataaaaaataaaggaaaagtaaaatataatgctgaaaatatagttgccttaaaatgccattgatatgatttttttttaaccttaaatctattgggcttataatattcgcggcaaaatgagcatttgaaaatcagtaatagaatgctatcaagcttcgttcatgacctttttagcatcataagtgttgaatcgaatctatcagttcagtaattaaaaatactatttttctgtcagcacagaacgtaacgacttttccttatatccactattgatttctctttaaagtgctatgtaaagtacctaaaaaacttgttatagaagtctcattcgaaagcatgtgggctcaaaaattgtgaataagatacatagaaggagccgctgatcgacacataatagtagagctgaacctagttggttcaaccattatcatagttatacgaataaagccacaatataaatggccaaccgctgttgtcaaacaagactataagttcattttaacctggcgtgcagtacgctggtcttgctaatgcctctacaatacgtacagtgcaggttttgacgaatgaaagtggttagaagattaatgtgatagaaacaagaattttctcgcaaagatcagtatgaaaggaaacgtttggtaagaactctgcgatccaaattctactgaatgaatagaaggcttctacagaacaagttgtatcgaaatgattgttggcgactactatatttctataggcatgaaagtcactcataaacaggaaagacgcattttagtagcttgacctggtcagattaatcagcttccaacgttacttccctttcgcaagaatctacccaaaatgtctcgagcatcttgataattacagtatcgttcgtcccgacttgacatttgtttaaatttctaagatgcttcctataggaacataattgtcaagaaagcacaacaaattgtctgcaatgtcaacaggagtggcgcattttatgttttttctattttttgtgcgtgatcattaagcgggatattgtccacagtcatctaaaagaatgaccatttcgacgacttagttcggaaaatatttccagcggatgacaccacttgccacagttggtgaccgccaaatctaagtcacgcgcggaaactgaaaggttgtgagtatataagtgatcactcgcttatataactgacgaggcagaacagggtgccaaaatgctcctcaatattttattcatttgagattcaaggcttaaagacagcatatataagaattatgacggccgcacatcctgttgctcagttaactgccgaggcataccctaaagtcaagagaaacccaaatttcaaagttctcgactcggaagatttggcgtactttcgttcgattttgtcaaatgatgaaatcttaaactctcaagctccagaagagcttgcttcgtttaaccaggactggatgaaaaaatatagaggccagtccaatttaattctcttgccaaactccactgataaagtgtccaagattatgaaatactgtaacgataaaaagttggcagtagtaccacaaggtggtaacaccgacttggtcggagcctctgttccggtatttgatgagattgttctttctctaagaaatatgaacaaagtcagagattttgatccagttagcgggactttcaagtgtgacgcgggtgtcgttatgcgtgatgcgcatcaatttttacacgaccatgaccatatcttcccattggatctgccttctagaaacaactgtcaagtgggcggtgtagtttcaacaaatgcaggtggtttgaactttttaagatatgggtctctacacggtaatgttttgggtttggaagtggtgctacccaacggtgagattatcagcaatatcaatgccctaaggaaggacaatactggttatgacttgaaacaattattcatcggtgcagagggtactatcggtgtcgttactggtgtatctatagttgcagcagcaaagccaaaagccttgaatgccgtattttttggtattgagaatttcgataccgttcagaaattatttgtcaaggctaaaagtgaattatctgagattttatctgcttttgaattcatggaccgtggctccattgaatgtacgatagaatacttgaaggacttgcctttccctctggagaaccaacacaacttttatgttcttattgaaacgtcagggtccaataagagacacgacgatgaaaagctgactgctttcctcaaagataccacagattctaaattaatttcggagggtatgatggctaaggacaaagccgattatgatagactttggacctggagaaaatctgttccaacagcttgtaattcttacggtggtatgtacaagtatgacatgtcacttcaattgaaagatttatattccgtatctgcggctgtgacggagagattaaacgcagccggtttgattggtgatgcaccaaaaccagttgttaaatcatgtggttatggtcatgtcggtgacggaaacatccatttaaatatcgcggtaagagaatttacaaaacagattgaggacttactagaaccatttgtttatgaatatattgcatcaaagaaaggttccatcagtgctgagcatgggatcggtttccataagaaaggtaagttacactacaccagaagtgatattgaaattagatttatgaaggatatcaaaaatcactacgatccaaatggaatcttaaacccatacaagtacatttgaactttgttaatttttaactttcaaagagcaaaccctttttctttacagtattatagatttacatatatgtatatatcaatttattattgatcaaaattaatataccataaaatatttatcttaagccgttgttcttgaacgattttcggtgaagaaacctaagaggccattttttgtggaaaaaggtcttgttttctatagatctgcgaccaggaatctcctgattgcgtacttcaaaaagtgttcgtccatttttctttactacattagataattatacataatccaattggagtagtgacatgagtattggtataaccttaatcctacaattttaaacacgtactaaagtgatctggactcattaaaactcaaatctcgtccagttttttcttcatttgtgatcaacatccagggagacacggagattatagtagttgttaataacacttcgcaattacttattcaagtatgttattaaatagtgaagagaaataagttttcagatcacatgttattctccaagaataattacataagttgccatttcaaatgtgcgcaaactaccttctgtattctttgcgctaatgccttactcagtctcccacttttaacgtttatttcttgtaagagtcgaaactaaaccttagttgagattaaattcaatcaagttcaagaagcgttctggcccacactttaaagcgactacaattaggaagagctcactaggaccaacgtattcaatgtggatatcatgaaaaacttcatctccaaaaagccaaaattctaatcataatgacagtggtgagaattagcaaggtaaaatattggcattatgtggcaggagaagggaaatacgagagcggagataagttggatattaatgagctttagatgttgaaaaaaaaagaaagcgttacaatgctcaataaaacaatgacttcccggaaaagattttttgattattttattccgagaaaggccgatgtatgctgaaccaacgtgttgcttgccaacttcagcatactttgtttgccaccctactaggaagtgaccccgagaactttattttttaagtgcctaaaacttattttcctgcagggcgcgcaataaataagggatatagcaaaacttgaaacatggggtagtttcgtgccttcttatgtgcctatcttgatttttgcctttgtgccttactctccttaccccgcgataccccaccgtatatttactctctccttggcacggacctaaaaataactgtagaatgagctcaacaaacaggtaaccttacgtaaactgttctttttatctttcagctcgccattttctgatgcagtacatagaactgtgatacgtcattatatagacttttcgcacaaacaaccaattaagcttgcgcatcagtggtggatatatggacggatacctcgtatattctgttgttgtcgtaggagagggcatcgcaaagtctagaagtaattaaattactttcagcgtttccaaatgagttcgagaacaattatattctagggggaaggaggttacagcggttgcagactcatagttccaaatttcatttatttttacatataaatagccaacatttatcatccaattgttaagattttcactttgtctagatcttcccctagattttctataaaaataaataaaaataatcaaagaaaaggaaaaggaaaaagaaaaagtaacaatttaaaacaaaaaaaaaaaaaaataatgacaaaatcagacgaaacaacagctaccagcttgaatgctaaaactctaaagagttttgaatccactcttcgaataccaacttatccaagagaaggtgttaaacaaggtattgttcatctgggagtcggtgcattccaccgttcccatttagctgttttcatgcaccgtctgatgcaggagcaccacttaaaggactggtccatatgtggtgttggtttaatgaaggcagatgcacttatgcgcgatgccatgaaggcccaagattgcctatacacccttgtggagcgtggtatcaaggacactaacgcttatatcgtcggttccattactgcttacatgtacgctcccgatgatccaagagctgttattgaaaagatggccaatccagacacacacattgtttctttgacggtcacagaaaacggttactaccacagtgaagcaacaaactccttaatgacagatgctcccgagattatcaatgatttgaaccacccagaaaagccagatactctgtatgggtacctatatgaggccctgttgttgcgttacaagagaggtcttaccccattcactattatgtcatgtgacaacatgccctaaaatggtgtcacagtaaagaccatgcttgttgcatttgccaagttaaagaaggatgagaaattcgccgcctggattgaagacaaggttacttctcctaacagcatggtggaccgtgtgaccccacgttgtaccgataaagagcgtaaatacgttgctgacacctggggaatcaaagatcaatgtcccgttgtcgcagaacctttcatccaatgggttcttgaagacaacttctccgatggccgtcctccatgggaacttgttggtgttcaggtcgtcaaggatgtcgattcctacgaattgatgaagttgcgtctacttaacggtggacattctgctatgggatatttgggatacttggcaggctacacctatatacatgaggttgtcaacgacccaactatcaacaagtatatctgtgttttgatgcgtgaggaagttatcccattattgcctaaagtgccaggcgttgatttcgaagagtacactgcatcagtgttggaaagattctccaatccagctattcaggacactgtcgcacgtatttgtttgatgggctctggtaagatgtctaagtatgttttgccatcaatctacgagcagttgcgtaaaccaaatggtaagtacaagttattggcagtatgtgttgctggctggttccgttacttgactggtgtagacatgaatgggaagccattcgaaatcgaggatcctatggcagcaaccttgaaggcagccgcagttaagggtggtaaagatcctcacgaactgcttaacattgaggtgcttttcagtcctgagattcgtgataacaaagaattcgttgcacagttgacccactccctagaaacagtttacgataaagggccaattgccgctattaaggaaattttagaccaagtgtgattttaaaggtgatctgatctacgcgccctcgatagtaatgactaaatatcttgggcagagtatatataatgtcgtatttttgtatattgttttatttagacaaatagtaacgtgttatgttccttcaatcgcatctttcatgatctttaatcgatcgtcaaatggatccatttagagtttctcatcaccatccccatatcatttcactccaccctgctttacgtaaaaaaaaaaacaaaacataaatgactaataatcagacacaattttgtcttaatggatgctttttacttatgacacatgccagtttgtacatatgttgatcttcatagctccgagaatcttcataaattcgtgacaaattaaaattacacattattatgtaaactataatatacaatgttgcctatcaagacaaacatatgcactctatgatcaatcagaattctttgagaacttcaaaaatttcttccaatccttcttctcggtcttactttcttcggaagaaatacctctcctagaaggtgggacccaagatgcagatttccatggttttataccttcttcgtatagtaattggatttcctccaaagatagaccaatcgtttctggtaaaaagaagaaaacgtacagaaacattgcaaccaaacaacctacgaaaacataaccataatagaagtggatagacccagtaatgaatggtgtgaaaaaaccgatcaaaaattgccataaccagttgcatgcagtcgaaatcgacatggctctagacttgactttcgaagggaacgactcggcaaccacaatataagcaacaggagcccatgtcgttgcaaagcagaatatatagaagcaagtgaacacaatcatggcattacctgcacctttcgaggatggaccatcctggccatgagggtaaagacatttcaccccgatacttgcaaatatgaccatacaagccatcatcccagctgcaccaaatagtagacatttacgacggccaattttgtctacgaccataacagcaataatagtggagaagaagttcactgtacctaggacgatcgacgtctcaaacccatcagtaagaccgactgatttaaaaatggtagttccgtagaagaagaagtagttttcaccagtaagttgcaaaaaggtttgcacaagaatacctgtgatcaaacgttgaaggacttttgttttgacggagaaaagttctttccatgaggcttcccctagttctctttgggaaaggacaccggcgttgatttcatcagcttgtttgagtacctatggatcctctggtgaaaccttgttgattttagcaatggaaacacgggcctcttcgtgtctctcacattcaatcagatatcttggggactctggaaccaataacatactaatgatgataatcaaagcccataaaaagcaaagcccaaggggcactctccattgtgcagtgttatcgtattttctcgtaccataaacgctacaataacccaagaaaataccgaaggtcatgttcagttggtacaatgagacaagaccacctctcaaatctgtgggagctatctcagacaaaagcattggacacaacaccgaacagccaccagcaccaagaccatagataatcttaccaacgaagtattggtaccatttgtgattcgaactgatctgaataattgcaccaaccatatataccaacaccacgatcacaattgccagccttctacctaaagtatcagcaagacgggcgaaaataagaccacctatggcacatccaatactgaacatagccacaagaagacccatacgcacgttgctcaaataatattcaccagtgctatgcttgtaagaaccgaagttcattttaaagttgtccatgttaatgaaacctgctgtgataccactatcccaaccaggcaggaaacccccaaaggatattggataacacagtaagtaaatgacaagataacctatgagccctctttttggtggctcaacgttatccccgtttataacttcgttgtcatcaaatccatctgaccactccttttccacaggtggtgcgacatgaatatcagcatctcgaatatctccatcgctatcaatagaggattgcgcactagacattttttttttttggtttaacttttgtttcttttttctttttttgattgttatgccttacgtgcaaagtaggaatagaagttttacctcaaacaactctgtttcatctgcctcttttatatgactttttagttgcaattacttgctggaagatacgacctcacacccttgaacgataaatttcgacaaacactatgttcatttgcgcatatatccaggggaatcaaccctagagagtactgtcttttcattgggttctgaatattcgtaaaccaggagttaaaggatattattatctaatattatcctcgaatatctacgtcatgccgggctagggcggattcaacctcaccatcttgcctacctacaacccaccgcacaagaaagcatcccacgccgcgtggtgcctttgttccttggttcctgaactgatgattatactttccccacgcacatgaaacgcataccccacccccacatttctcatttaatattttttagttttaactccggtgcgcgccccttgaagttaaattaaactaactgtctgcatagttcaataaacgatgtcgacaacgattaggtgattggctagccatcgcaacaagcagacatcaactgaaactctaaaatgtagtcctacagacaaaaaaaaattgttgttttcaggcttatgttcaaggaaaggaacacgacaaatgattgtcaatagtatgtttctctgaaggcacaggttactttttaccgaatgtatttcaaactgcctttagtaaggaaggtgcttttgcaacactttcccccttcgttgtgaagcatttggcagtacagcgataaatcctagacattattaaattggtaaaagggtgccatagaaggacacgacaaccagagctcgtaccattactactttgttccattctaaaattatagaattcgcgttaaaatgtccgggtttctcagcacttcagattatagacattttgtgaaatagcaaattgcagcatgatcggtgattagcaataacggtgtccgagtcctttccctctcatgtttttttttcaactacagtaattctcagcagctgcagccttgaaaactataggtcaatgataatatgtattaataaccaactcttggcgcttacaaaattgatttatttagtcaattgacccacatggaagggtaaaaccgcatacaaaaatttctcttacaaaggatcttatgaacatatcaaatcaattatagaagccggaaagactgtcatcctatatagggtggcaatgttattatcaggaagggtaaatctcatttctaaattgcggaaggagctttgctctggttgaaattattatcattatcgctacttcagcgatttcaattttgcttactagataccagcgtcaaggtcctatcttttgttgtgttgctgcctcaaacatgttagtttaagtttgaaggttgacactgtaaaatttactttgtatattgcatttatggatgatttacagtgtttcaattatgctctattgaggatagtgcttttgcagaatatttcacttgaggccacgcatactggcctaaggcattacattttgaaataatcttcgcatggggcttgtcacagtcatgaaaggggaaataacttctagtatctggcatgatatgtccttacaaaacttgatctttcacagcataagaattattacatcctaatatagatttccgacactgcagtgaggcagatgccaatattgaatcgaagttttgattaaggtatgtgagagtgtgattgtttgacatccctccagttgttcgaagatatcaacggtgcaggaaagccgctgataaaatggtcgctccgtggttgaaattgtagtgaataaccacttttacttacgtagaactttatccttttggctgtggtttgaaattattcgttttcttcccaaacgttgcagggaaataagaaaaaagaaggagaaataatacctgacaacgtagcagcgagtcttagttcatctgctcaggttgaaaaacattgatcttgagcattttcatcttgcgctttaaatctcttggagtataattaagagcaaattgtaatagtattatgacatttgcaggactcacacccagaagtcctttccaccacttcagtactgtaacttgaaaaaaaaaaaggagagaattgatctaattaaaattatatagttattcaaattggaagtaaataaataaggactgccggcccatttttcttttttttctcttaactgacctgatatttttgaaacacttaacgccgttttcttcaattaaatcagaagtgcaattagtggtgctttgttaacatatgtttgagggcctactaaatgttagagtggacagttcttgcttacaatgattaagaattgatggctagtaatgtgggcggtcgcatctcgcttgtctaaggatggagttcctaaattcttcacgatcgggaacaggtcctttgtcccaacttgccagtttatcgtcaacgagtttatcaatctcgtcgtagtggatagtaatccatggatgatcttcattaccgcaagtagtccaattcactggtggtagttttacgctccaaaatctcttatcataatccgctatgcggtaaaatgtcgatgtattatgcgtaaaattgttataattgtctgttgtatccgtacagcataccaatgccaagccttgaaaggcgacggctagtgccaaaattttcatcctttcagtatacctgattttggctttatcctttcaatgtgcctgattttggctttctcgtatctttcgcctgataatatgaaaaagtatatactgtgaaaaaacaaccgttggagagctacgaccgactgaaaagataaaaatgcttgagtttttcaggttagcatgccgtctagtagaattaaaccattgtagttcttcacttttgtattaaacgtaggattgaggcggtggctgcttttggtttactatgcgttgtaaggggatggggaaatggaacgtccagaagaaagttatagttcccgtttgcataacagcagagacaaaaatggtcgagcacttccgtgttgactgtatatctgtgcatggttgactaattgttgtttgatggcctgaagttcttgtcacactctgcaaattatcccgacattcagacgtacacgcacaaaacacgaatgctactctagcatatccaatcgatcgcactgaagcgatcagctgatgatcaggcggtacattgcatactctgcgtaaggcctttttcaccaattgaccgcatcgtatatttcccaatccggttattaaatcgttatcaggcggaaaccttcgcgaacaatatactggagagtgttgcgacaagatatttaaaagcggaaaacgggcatataaaatagatgagtgcagactaatgaaaaagactccagactcatctccaccttttgcaagcacgaagaacgtaggcatgtcaaacgaagaaccggaaaaaatggttaacgatcgaattgtggtgaaggccatcgagccaaaagatgaggaagcctggaacaaactgtggaaggagtatcagggtttccaaaaaacggttatgcctccggaagtagccaccactaccttcgcaaggtttatagaccctacggtcaaactatggggtgctctagcctttgacaccgagaccggcgatgcaattggctttgcacactacctgaaccatttgacgtcgtggcatgtcgaagaagttgtctacatgaatgacttatatgtcactgaacgcgcaagagtcaaaggcgtaggtagaaagctcatagaatttgtatacagccgtgccgatgagctcggtacgcctgcagtgtactgggttacagaccattacaatcaccgcgcacagttgctgtacaccaaagtggcttacaagacagataaggttctttacaagagaaacggatactgaaaccgctgtgtaatgtagactactgtgtatagagataactctagcttctataggctcacttgcgaagcttttttcccactttttcccagtgaaatagtttcttattggcttttcatagtttgttctccgatttaatcgcaagcgccgtacggcgcaggcacagaatgacttgcagcttaatccaggtgcattttaagaaacttatctgctgggaagaccccgaagttcatcgtttacaatgtgccgtaaagaacacatttgagggtgcaatctggttcgtcttttgccataattagtagtgctcatccgtgatcctttaatttacttttgtgatgcgatgatttgcagatactatataagcaatggacaccgtccatcaccgatgaggctagaacatcgtagtgctttgtaaaagaactgttaaagacccagtacgaaaatttttccataatggaccctggtattgctaatcataccctccccgaggaatttgaagaggttgtcgttcccgagatgctggaaaaggaagtaggagccaaggtcgatgtcaagccaacgctaaccacatcttctccagcaccttcttacattgaattgatagatccaggtgtgcataacatcgagatttacgcagaaatgtacaaccgcccgatctaccgtgtcgcattattcttctcacttttcctcattgcctatgcttacggattagatggtaatatccgttacactttccaggcgtacgcgacttcgtcgtactcccagcactcgctgctatcgaccgtcaactgtattaagacggttattgcggctgtaggccagatcttctttgccagattatcagatatcttcggcagattttccattatgattgtcagtatcattttttatagcatggggaccatcattgagtcgcaagcggtgaatattacaagatttgcagttggtggttgtttttaccaattgggtcttaccggtattattctaattttggaagttattgcttctgacttttccaacttgaactggaggttgttagccttattcattccagctttaccatttatcatcaacacctggattagcgggaacgtaacaagtgccatagatgctaattggaaatggggtattggtatgtgggcttttatactgccgctagcttgtattccgcttggaatttgtatgttgcacatgaggtatttagcaagaaagcatgctaaagatagattgaagcccgagttcgaagcgctaaacaaattgaagtggaagtccttttgtatagacatcgcattttggaaattggatatcattggaatgttattaattactgtatttttcgggtgtgtattggttccattcaccttagcgggtggtttgaaagaggaatggaaaactgcgcatattattgtccctgaagtcattggttgggttgtagtgttaccactgtacatgctatgggaaataaagtactcgagacatccattgacaccttgggacttgattcaagatagaggtatctttttcgctctactcatcgcattctttatcaattttaactggtatatgcaaggtgattacatgtatactgtactagtcgttgcagttcatgaatccataaagtccgctacaagaattacctccttgtattcatttgtttctgttatcgttggtacaatcctcgggttcatactgattaaagttagaaggactaagccttttattatatttggcatttcttgttggatcgtctcatttggtttgctggtccattaccgtggtgactccggtgctcattccggtatcattggctctttgtgtctattaggtttcggtgcaggttcatttacctatgtgactcaagcttccatccaagcatccgctaaaactcatgcaagaatggcggtagtaacctcattataccttgccacttataatattggttctgcatttggtagttctgttagcggagctgtctggactaatatcctacccaaagaaatttcaaaaagaatttccgatccaaccttagctgcacaagcgtacggttctccatttacattcattacaacttatacctggggaacaccagaaagaatagctttagtcatgtcttaccgctatgttcaaaagattttatgtatcataggtttggtattctgctttcctttgttaggttgcgcattcatgttgagaaatcataaactaacagattctattgctcttgaaggcaatgatcatttggaaagtaaaaacacctttgaaattgaggaaaaggaagaaagttttttgaaaaataaattctttacgcactttacaagcagtaaagataggaaagattaatattatctcacccaaataatttcatacatgcacatatagctactacatagtcaagaacatatcataacatttggtataacagtctttatatcagtctttgcatggctttgcatctgatgctggctctaccgacttctcggcgataaaataccaaaagaatttgacgtatatactatccaaagtggataaatatttgagttccaatgaggtaactaaactagttttttaaaacccagcagaaagaaaaaataccctatatttggcagtgctgtccatcagaaccattaactgcatcaataatagtttgggtgctgctgattatcataatcatgaaaccaaagcatatacaaagatagaaaggaagcctttccttccaactcttcttcttactagttaacaacaaatttgtgtatggcggcaaaatgtaagccatagtcgatgccgtagtggccccaatcagttcaaataatgctcctaaattacatgtagttaatgatatacccatggtgatgaagactagtgaagaagttataacgacgtgctgtttacctgataattgagtgtgttcgtcataatttttaataaggttgcattcatgtaacaagttaccgacaacatctctcaaaacaaaaatttccatggggaatgtggttagcatgttaaatccgaaacagagtctggctatgttgatagcagtgtctgttcctgggaaactgtttaaaacattgccttttgttttttctttgaaaactgcaaatcccgaatatcccattagtgcacagcatattactgagataatgatactgatatgcgttaacctggtaaattttgccacacttctattcctcatggaaaagaaaataaaactagtattatgatgacaaaccaacgcaaaggaaatgacagagagacttctgaatatagtagctttcatgaaaaaatcagataacttcagagaatgacctttccaatcatagggcagcataggtcctctaattaccactgtcagtacaattataatcatacttataacggccaagaaagatgcctttgatagtgcctctatgtttctcttcattgataacggaaaggaaatgaaagtagtgaccattacaattatgacatttcgcctgagccaaaaatgtacattaccatcgttctggctgaatatagctctgagtacgtggggtatcgtatccccaataattatgcaataaccaatacatccaccaaatgcaaataacccgtttgtaaatagaatcagcaatttcccttttttacccattacatgttcgaccgtaccctggtatgttctcttgccagcaagagtcaagttaatgacaataagtcttaacgtccaatcaactataaatccgagggctacgtatgataatagcccgcctaatataccagcatttttgatcgcgaacggctgagtaattattccggcaccaagaatagagtttgctagattcataaaagccattctcatactagactttttatcgttttctcgaagtacatcattaaccagagtatcatccatgtcaggagtaatgatattcaaagagttctgcccttggcttccgtcatcggagtcgttatcagttgtgcctggaaaaggaaaatttgtcaattcaaactccgttctaagctctttgttttctaatttagaatactcacctaactcagacattatcggaacatgtatatctgttagattctggtcgagatattctttaatggtttagtgtatgttgcgcttactactttttggcgtttttgcctatttcactatttacatatcgtgaaaatgacatttggttctaggttcgggtgacgtgaagataacgaaaaatgagtaaaaattatcttctaattatacattagtattagcgtgaaaatgtacacatatacatatatatatatatatatatatacttgaaggtctgaaggagtttcaaatgcttctactccgtctgctttcttttcgggagcaagattgttgtggtgaatcatcgataaaaataaatatactgagattatagtaagctcattgatcccttaaactttcttttcggtgtatgacttatgagggtgagaatgcgaaatggcgtgggaatgtgattaaaggtaataaaacgtcatatctatgctacaacattccaaaatttgtcccaaaaagtctttggttcatgatcttcccatacaattgcctcaatgtctcttctatcggaatcgatgtcgacatctccaatcttccaaataaatctgcatctgaatatgcattgaaataagatccaaacagctaagaacaggaaaacagagatataggcggcagcaaagctaacaccattgaattttggtgcaaaagccgtgaaaccttgaataatgataatgatcgtcataaatgtggccgcataataagccaagccgggcattaatttagctttaaatggtaactcgtcacgagagatgccacggtatttcaaagcttgcataaatctgatgtgcgagattgagataaataaccatgcaaaaaagcctgcaacaccagtgatatttaatagccattcgaaaactttgtcaccaccagtagatgtctccatgtaagccaaagcgccaaatgcagcagtaacgaaaactgcaatgtatggaacaccacctttggtggtccttgacaggaatttaggagccaacttgttctttgatagaccaaataaaatacgggaaccaacgtaaatatttgaatttgcggcagaaataatggttgttaagataacagcgttgaagatatgtggcaaaacctttgtaccagagttctcaatagcaataataaagggagaagtagaaacgtaggaagtagattgtgttagtttagggtcattgtatggaactaaaagtccaatgaataatagagagccaatgtagaaggttaagatacggaaaacaacttttttgatggctcttggaacggattttctggggtttgcagcttcaccagcagtgataccaactagttcagtaccttgaaatgtgaaggcagcgttaatcaaagaggaaacccaacctaagaacctcccttcgtttttatccttagatattatacctggaccccaggcacctgggtttctccaataacggaatccaactgggccggtaaccccagcaccacaaaccatacaaaaacagtatattagaaacccgataatggctaaaactttgatggaagcgacccagaactcgaattcaccgtaatatttgacagggaacaagttcattattgtgataattacccaaaaaatactaatccatgccgccagtggaactttgtacgtccaaaattgaatgacttggccaactacactaagttccagggcaaaagtgattgcccaagaaaaccaatacatgtaaccattggccgcaccaaatgctggagaaaggaatctttgtgagaacactgtgaaagaggatgtaacagggatgaatgtagccatttcacccaaggactgcgtgacagaatatgccaaagaacccataaataaatatgatataagagcgcccactgggccggcgttggtcagaggtgtggataaaccaatgaaaagacctgtaccaatagtaccaccaagggcaatcataccaatatgtctttgcttaagctctctcttcacttcagcgttctgtacttctccttcatcttcatcacctatgccatcctccatagagaacgtatcctcgccatttactctcgtcgggaaagagcgcaatggatacaattctttacttttctcatcttttaatggtattgacccacgtctgtggtgtgtttgtgaagcttcaacgtcgtgaaagagggttgtgaccggctcattgtacatatgcttctcctctatgtcggcgtcttcttttgaatttgtcattgctatgcctttttttttttttgtttttacaggagttaagaagtctgaagaactctgaaataaactttcgattgacgacagattgaaaactggatccaactataagtataatagtaacttatatatttctgttccagatatatacgtaaaaaaaagaaaaggataattgatgtttttgcaaaaagggattccctgattcggtttactctgttcgcaaccactcttctttctgctaatttgtgctttatctcgtatcattctcttatctacttatcttaaccttatcgtcttcctcgaaattttcattgatagagaaaactgcaaaaaaagaaattcaaaaaagccgtatgactcacccggaaaccacacagaaaccctagatttttatagggcaaatttcagggttatactaaaagatatattattgaccttggttattcttcaagttcgccctattgaaaattcggacactttagggtttggaatctgttaaagatataagtaaatatgatgataaagaaataggtttaatttatacgcacttgccagtaagtgattgatattgcagaagtagcatgaatacagatctgtggcctttgctgtttgccgttattttatttctttttttgtttttttcttttttcagcactatcaaggctaataagggacaagagttcttactcagtgtgaacgtgttctaaataagttcttgttctaattaattgtaactatttttatgcatttcttgtaagaggaactggagtaatcgtatctcggaaatacatagaggtgcgtattcataatgggccctctatcacttgttgcctgtatctccgaataggactgataagtgataaaaaaaaaagaaaactgggttagcttgaagcgactttctttctctactaaagggaatggtcagatcatcaggccaacggcaaatgctaagctatttccaagggtttgtgcccatacacacaatattttactccgtgttccatcctacagaaggttctaagattaaatatgagtttccgccaaataatttgaaaaatcatggtattaatttcaacacatttaaaaactacatcataccgaagcctatattatgccacaagttgatcacttttaagtatggtacatataggattgtatgctatcctgtgacaatcaattctccaatatatgctaggaatttttttagttttaattttgtatttgtattcccatatgattgtgagacgtctccctacgaaccagctattactaggctgggcaaaatgttcaaagttcttgaagaacaaaatcaattgctatccaaatcggaaagagatccagttttctttgatttgaaggtgttggaaaactccacaacaacaccctccactgcaggtccttcatccacgccaaatcctagtagtaacaccacaccaactcatcctacatccgaaaaggatacaaaggatatgagaagcagcagatacagtgaccttatcaaggatttgggccttccgcaatccgcattttccatacaagatttattgatgagaattttccaagacctgaataactactccgaatgcctcataccaattgatgagggaaatgcagtagacataaagatttttccgctgttgagaccaccgacaacttgtgtctcattagaagatgtgcccctgtcgtctgtaaatttgaagaagattattgatgtcaactgggatccaaccatgatgagtatagtcccttacattgatggcttaaacagcattgccaaaatttctaaactaagcaacagtgatcctggcctagtgatagagtgcatacgtcacttaatatactataagtgtgttacattatcagatattttccaattttctaacatatacgctccttcttcattaattaggaattttttgactgatccactaatggctagtgactgtcaatcttatgttacgttcccagaagtgtctaaaatatcgaacttgcccttaaacaaaagtctgggttcaggtgaccaagactcaccatcattttctgtacgaagaaaatccaaatcatctagcataccgtcaaacccggattctagaactacatcttttagttctaccagtagagtttctcaaaactcctccttaaattcctctttttcatcaatttataaagactggaggcaatcacaaacctcctgctcgagttcaaatattcatgtcatcaacaatcgtaaccgatttctaccaacaagatcatgcctatttgacctttataggtcactttcacaaggtcaaacgctgaaaacatggtatgagtcgaaatatatgattttaaaagaaaataacattgatataagaaggttcataacgtttggcctggaaaaacgtatcatttacaggtgctactcttttcctgtaatgataaatgcaggttcacgtgaaccaaaagaaatgacaccaataataacaaaagatttagtgaataatgataagttacttgaaaaaagaaatcacaatcatttgctttcagccacagggtctagaaatacggcacaatccggcaacttgaaaccagaaagaccatcaaaggtttcctttgaaatgcaaagggtaagttcgttggcaacaggcaaaagtactatgccgaaactcagcgacgaagaagaaggtattcttgaagagtctattaggaatgccgaaacatttgataaaatttgcgttttactgagcaagcctaaattagaagtcgaaagctacctaaacgaattaggagaatttaaggtaataaatagctgagttaaaattagagaaattcattgtccatcaaaatgttttttttttttaatattacaacttatttccgtaaataaagatagtacacacgaatccaaacgtttatatagttagctctgtgaaaatttgatttaggttcatctcttggtgtgtttggtagaggtggtttcacacccttctcttctgtcttgccttctaatgaataactgagtattctttacatactttgtttttattaaccactagtttgaatatatattcgactgaaaggcaatatcaactattcaatctttaacatttttcttgagccctcattgtccacattttcactggatttgttttcatcttcaattgcatgctttttgggcgatattacactttgcactgaattgctatttatgtttgataaccttaacggcattttcttacttagatttggtatttccttcaatatgttctcgatcatttcgtctttggtagcgttttccttgttaccatagtttttcattatgttttcaatcgtattatagatatcatccacattagttatatgagagtgtgttgatgttatcgaatttttaatgttatctttcaacatgttatgcttgttaataagctgctcaaattgatcattaaatttggtattgttcttcaaaagggatatagcgttctccgattcttccacttgtcctttcatgactgaaatagactcattcatcgaatttgatgatgtatcaacagtactcttgatttgcgatagcgtcgctgccatgctattataaaattcgttattcatggagtcacaatcatttatcagatcaaatgaattttcccatttaacgcgcttgggttcaaacagatccatttcttgatcaataaccgcgctggttgcagttgtcagattctgcattattagttttttattttcgtcaaggtggtcatttaggacctttttaaagttctcaacaaactcgtttgttctcttctcaatattttcataagtagaatccacatgacgattcagtaattcttgatggttattcttgaaaaaatggttttttaagtactgtttcatgttgttattttcttcgctaatatcagaaagattctcggctatatttttataaaatttttggaaatctactcttattacgtcgattttctcaataacaacattgaagaattttggagattcgtttaaaattttcttcacacagtctttgtacattagttcagctttttcttgcatggttctcataagagtcagtacttcatttttgatcacatcaagatttggttggatattagtctcttgaagaatactttcctgttgcatagtgtttaattgtaaaaacagtgtagatttcaattttttaatttctttagtaatatgcatttcaaacttttgattaaggtcaagttctctttttttgtaatcatgtagggccatttgcattacctcagtcaacttctgtagtttgttattaaaatcagatatttcaatttcagttttatgctgtttatctagttgtgcccttaaatgatctatggtagttttcaatgattctatttggcaattttgagattgaatagtttcttttgacttcaatttatcttttactagcaatgcatttttcgatgtcaaactttcaatttctcttttacattcttgaacttcatttttataactttctaaatcactgttcaaatttttgtagtgatcttggctcatatatattccttctttggactttgtagagagtaaatcggatttaatctttgctaattccatagttatatttttaaccaaaatatccttcattataaatgaacccagttgcggcttgttcttaatgtttttagccttcgaagcatactctaatgtactgcaggtttcttcagaagttacctttgcaggcgatatagtagcaattagtgcggttttcgtattaccacccagggaatcttgaagcaggcgggtcaatttcgattcacggaaaggtatatggccgcttttatctacgagtgcgtttatgaccctgcccagcgtcaatagactttggttgattgaaccagcttctttggcacgttgatttaatgctccggatctgttgatgttttctgaaccagctaaatccacaagattcattttggaaattctaaatagttcatcctgatgcttcttatacaaagtgattgtaaaaatggtatgagatctactggaaaaatcgttcattttagtggacgctacttgcctatgctttaagcctttttgtaataggtttagcccctccatagcatttgttatgtgaaattcttgcaaattctggatgtatataccattagtttggtcatttggagccatcgaacttctttgaccgttatttgtgttggtgttactagaagcattattagtggtagggccagagttagaggaagagttgttcctggaattcactgcttgttgttgttgatactgttgcttgatggtattcggcagtgattttgtccttaacctttttcttaatagagcagctttaggtgttagatcatttaatgacctcggagaactgttcctagaattactcctggaactactagcactgttgctagtggtattatttgctgtgcttgaatcaaaaatcctcaattttttcataaattggccgtcaaagccagtattactagagccgttgctattgctgtccaagaggtccttcaattcttcgttgtagagttcaatgaacgaacattttactacgtaatcgttctgttgtagttccaatgtgtcaaacaacttcaaaagaaccctcggtataattcctgctgcatcgctcaattcaccattatataacttttcgtcgcccgtcattgtatatgttttacctgttgacgtcataccatataccagtacggtgcaattataacctttaatgaaatcctggaataatgggcccgccacttcatcaaaaattagatcctgggaagcgccgggaccgaagactttgtccactgtgtatctcttggcattcatttgagcagttataccagtatctcccgtcgtgttaatggaaatttctttagaacctgtaatatctggaacatttaccacaacggagcttttcatactaatttccctttcattccttcctctgcatcgcacagctacagtgatgttcagttcctcattaggaacagtgtgacatccaacctgagagttgccatttttactgatgctgttggagcttctatcttgacccgtattttggttttccgctggcatcaaacaaattctttcttgttgtattttttgcgcttttatatactttttattactttttcctttgaattgcttgcttctgtatctatactcaacgttactttctggccataccaaaagttctacacccgctgttgagaagcgggtcacaaaggaagtctttagatgatgttattgttgcggccttgtttgtttgttttgtttatttcgcgtacctaatacatcgtcaccacacacgaaaacgaaaacatttgatcagataagtgatctgcaaataagatataataaaagtaacagttatttatttaattaaaaacgcaaatatgtagtgatacgtgggacatataaatttcatgaattaaaaaaaaatgaaattcagattgaaaataatggggatataaaaaaagtggacaaacgatagtgaagagggactccgacttgtaacctcgagacgcctaaggaaagaaaaagaaaaaaaaagcagctgaaatttttctaaatgaagaattaaataatattcaatttatcaagaatatctctcacttgatcaaagattaaatcggtctttgatccaatgaattcatccatgttcaattcttgcttgaaaccagatgaatgggactttttggtatcattccagaaagcggacaaatcttgaccaccaccgttgtagattaaaacatttggagtgtcttcagggatatcgaacaaaatgtcctttgtactgtaatgaattagcttctttttcaattgctgaggagtcaaagaatcctggcccaattcgaaaaattcactatcagaacctggttgcaaagacaaaaagtaggtcaacaaaccagcaacgtgaggggaagccattgaggtacccgataaagtggcggtggcgtcatcacttccaatgtaggtggacaaaatgtttaaacctggggcgaaaacgtcgacacacttaccccagttggaaaagtaggctctgtcatcgcttaacgtggaagctccgacggtgatggccttgtcagcagaagctggggaggtattacaagcgtcttggttttcgttaccagcagccacggcaaagtgaataccggcttcaacggctgcattaacagccaagtccaaagctggggacttgccaccaccaagcgacatattggctgtggaacctttgaacccctttttcttttcttgggcttctttttggtgcgcctttgcggcatattcgacacctttgacgacatcagacatggtaccagacccgtttgatctcaagactttcaccgcaacaacgttggcatttttagcgacaccgtagtgtttggaagcgatagtaccggcacagtgggtaccgtggccgttaccgtcgagatcttcgtcgttaagtgggatggttttcccccaaatggctctcttttcgaagtccttgtggttgatgttgacacccgtgtcaataacgtaggacgtgacaccgcgaccggcatcatcatcgtagagatacttgttgaaagaccccaggttgaggcgctctctgtgggaaatacgggccaacccccatggggcgctattttgagtgtcaaattctgtagcctcgacaatagagtctctctcaacaaagtctactaatgggttttgacgtatcaagtcgacaatctcttgggtgaagtaaccgatgtaaccggagaaaagattatcgatgttgaatgagtcctggataccgccagcctcagaggtggacaaggaggtgtctttagtagaaatgaagaaagcgtcttcggcagataagttctctacggattgaagttgtgcctgctggacgttttccttgtggaaatcgatctcttcttgaggggcacctctcttgaagactataatgtagcggttggggatgatcttggagatggcgtctgggttgaattgtgcagtggacacgagaggagccagcctgttgtggtgcctccctttctccaacgtcttttcgtggtgcttcttgcccttgactttcttacctttcaccttcttctcctccaccttattttcgtggcagccacccttatggtgaggcttcttcttcttatcatcattatcatcatcattggaactttcatgcttaggcttcatgccctttcctccctcgtgggcgctcccatgagagccccttgcacgtttaccgttgaattcgggagactccttgtcttggcccttgcggcccttcttatggaactttccatgttctttatcttcagagtcagatggctcctcatcatcgtccttagtgaattccacttttctgggtctctcgtggtgatcttccttgttaatcagttcgtggtggtcggcggcattttcaagatttgggatgaccaaagcagcagagatgctccctagggcaccgagtgtaaatagagtattttctaacttcatctttgcttgttagaattaggtttagtttgtttttttattggcgatgaagctaattggactcttaagtttgtatgggaagaactccaatataacgggacgtaacattggcccccttttatattcatcgcgctctttatcgcgggtgtgtttgcccccgccactcccgcagtcctggcgtgataagccactgcagtggcattactgagcccaaattttgctttttcaacaagtcacctaaatttccaaagccgaaagccctgctactctgctaacccggagcgtttaaagtccacggacattttccagccctcgttttttctcctcccgggaccccgggcataagtgcatagtaggcacagacctgatctgtcgggtgcagtttaaaaaagtcttggcaaaattttttatttatcacactactgtgctatatagagtatatgtaattttttaactattggtatatgtatccgtgacctcgtagttagtggctgatttgtcgggtgcaatgcagtgttcaaaaagcctcttaaaaggcgaacagacgtattcggctcctttgaattggcactcccattgcacaagctctttcagccggcagttggtttgtgagtcaagcgttgctaacggtgcgagcgcttggtccctagtgcggatggtggttggaggcgccatgagggttgattgtcttatctgcgatagatgagtctttctttccttctcttttccccttttctccccccctgtttctcgtccatctctatctgtctatctgtcttatctactgttagtttttttttcgctttcacgataccgcattacgtactgcgctgcggaagtgtggatgagtggcatatacactcttctgcagaggattttcgtacacaacggtgtgtatgtgtgctgtgaagctgtctgcttccttacttggctgtttgcttgcttgtgcgtcatggtcacttttgttagaagtgagccgcataaaatggcatgtcggcacagcctacagttaaaaattaagcatatctgactgtttatctgtttatctgtttatacacggtgaactgtcacgagaacccttacttgcacgattagcagattgttcagagagcctcgctcgttgaagctcttctatatgccagcgtgtttcatgtagcaggaaacgttgctctatttatatcttttctgacattttgcgtcgtcgggaaaaaaaagattaagtaagaacaaaaaaccgttaatggtttcagcaatcgagacaagtacaaggaccaaggcaaaggtcagcagtaagtttagagacgatgaaggttgattacgagcaattgtgcaaactctacgatgacacgtgccgcacaaagaatgtgcagttcagttacggtacggccggattcagaacgctggccaagaatttggatacggtgatgttcagtactggtatactggcggttctcaggtcgctgaagcttcagggtcagtatgtgggggtgatgatcacggcgtcgcacaacccataccaggacaacggggtcaagattgtggaaccggacggatcgatgcttttggccacatgggagccatatgccatgcagttggccaatgcggcctcttttgccactaattttgaagagtttcgtgttgagttggccaagctgattgaacacgaaaagattgatttgaatacaaccgtcgtgcctcacatcgtggttggaagagactctagggaaagtagtccatacttgctgcgctgcttgacttcctccatggccagcgtcttccacgcgcaagttttggacttgggctgtgtcactacgcctcaattgcattacattactgatttgtccaacaggcggaaactggaaggagacacagcgccagttgccacagaacgggactactattcgttctttataggagccttcaacgagctcttcgccacgtatcagctggagaagaggctgtctgtcccaaaattgttcatagacacagccaatggtatcggtggtccacaattgaaaaaactactggcctccgaagattgggacgtgccagcggagcaagttgaggtaatcaacgacaggtccgatgttccagaactgttgaattttgaatgcggtgcggattatgtgaagactaaccagagattacccaagggtctttctccatcctcgtttgattcgctatattgctcctttgatggtgacgcagacagggttgtgttctactatgtcgactcaggatcaaaatttcatttgttggatggtgacaaaatttccactttgtttgcaaagttcttgtctaaacaactagaattggcacacctagaacattctttgaagattggtgttgtgcaaactgcctatgcaaacggcagttccaccgcttacataaaaaatacgttgcactgtcccgtgtcttgcactaagacaggtgttaaacacttgcatcatgaagctgccactcagtacgatattggcatttatttcgaagcaaatggacatggtacgattatattcagcgaaaaatttcatcgaactatcaaatctgaattatccaagtccaagttaaatggtgatacgttagctttgagaactttgaagtgtttctctgaattgattaaccagaccgtgggagatgctatttcagacatgctggctgtccttgccactttggcgattttgaaaatgtcgccaatggattgggatgaagagtatactgatttgcccaacaagctggttaagtgcatcgttcctgataggtcaattttccaaaccacggaccaggaaagaaaattgctcaatccagtggggttgcaggacaagatagatcttgtggtagccaagtatcccatgggaagaagctttgtcagagccagtggtacggaggatgcggtgagggtttatgcggaatgtaaggactcctctaagttaggtcaattttgtgacgaagtggtggagcacgttaaggcatctgcttgaaagcattattcgatgtatagtatagctatttagatatacagagagataaatgaaagagaaaaaatattggtatgaatcaacgtttgttacaggcttagactttggtttggtaattgaaattcatggtagtggaaataaacaaaattttcctcttcaatttttttcgtcgtttcgctctgcaatcgaaaatcaaataatcttcataaaagaaatcactttcaataaatgaacttctcactaccataatggatgatgtggccgattcgaaagcaatacggttgactaacacggaaaccccgagtgataagtcaccaaaaaaaattctctttacgatgaatgttccgaatttgttctcctctttacagttttcgttggaaaggtatttatatgtaatttccttcagaattctcttgttttctatgttggcattgtcgagatgaacctgtttcagtatggcattgggaaaaagtgtagcttgtaactttaaaacttgatcatgcagtgttgcagctaaattatccagagtaaaaatttcctctttggagtaaatgcctagcaagtttttcagctgactactccaacctcgcctggccctgtgctttctacttacacaatctttgtgatttggtggtaaggtttttggaaaatgaggaagagtatctagttgttgggtaatgtttctttccaagaatgatatttttttcattatgacgtcaatttctttagaataagccgagaactgtacagttttaaaaccctttctgttgtcattcctctgaatcccatcatttgccatttaattttcaatttagttactagtcaattttctttttcgccttttgtattccataatatgaatataagcttgggcttgccgattttctccgcttaatattaagcctacgcatgatgtaggttacattttgaagggtttcttttaacttccttacttatttatatatgtatgaacctacacaaggcattttacccttatttcttcccgcaacatttgataaaaagtggaagacgtttgtgattgttattatcgccccaattttctcctttttttcttttccttcaacgtcaatcaattgcacattcagccgattggctttcttagcgcaggatagggtgtcggggatacctgtgggaagttagtgacacttttttttccactctcttcatggaatccccggacggcagccgcccgtcccaattttggcaaaattgacatcctaactgcacgaattctcatcgcgtatcagaactcttgagccttcagttttactactcaatgctctgatttatctatatatacataaatgaaaataatacgtgcgcatttataagacaaaaagttagaattctgaccacgattgcatgctgtagataattgtcgtgttcattctctctttaacggcgcctcaagaagaatataaaataattgctcttgcagtctcaatgagtcggtatgttcaaagtggtgcccaacatttactaatattggtctgcggtacaaaatcggcggctaaactgtctaccgataaaatactcttgatttataagaatgaaaaagaaaacaaaaagggatgacccctgaaaaagtttgttttctttacccttttttatgttaaattttacatttattaccgtttacgtcaatcgcaatatacaggtggggcattgttatttgatttcataatctggtgagaacgttatcacgcggattatttagtttttttaaaccatgtgcgaagaaattctcatatattgtaggcatttctgactcaaacttctgctgcttaaaatagctgttttcaccttttttttcctcttgttctatttgacatgctccctttcttcctcggtcctttcaaccatttccatgctcctgtaggctcaggagcagagcgaggaaaaaacttccctacagaaagctttcatgtttttaaccggtttcctttcagctttttcttttggagtaatctagaaagattaggtcatttgttcagtctatttgatacttgatgagtagctcgtctgttctgttcaaaataacaatttgtgaggtgtacggatgttttcactggcattcgtcgacatgacaaagacaaaccttgaaaataataatggagaataactagaaagacgttactatgcctctaatacttctgcctctcttatctctcctatcaattgtggttagcctagtagtcaccaaatagcaaattaccaatcaactatggaaaaccaagagaaaccgctttctgtagacgaggagtacgatttatggaaatccaatgttccattaatgtatgactttgttagcgagacacgtttaacatggccatctttaaccgtccaatggctccctactcctgttcaagaattagatggtggctttattaaacaagaattaatcatcggtacgcacacttctggtgaagaagaaaactatttgaaattcgcagaaattaatctaccaaaggaaattcttagtaatgaagacccacaagaagaagcaggagaggagtatcagtcctctctacctgctcctaggtcaaatataaggattaccgctaaatatgagcacgaagaagaaatcactagagcccgatatatgcctcaagaccctaatattgtcgccacaataaatgggcaaggcacagttttcctctattctcgctcagaaggtcttcagtcaacactaaaatttcataaggataacggttatgctttatcatttagcactttggtcaaagggcgattgctttccggctcagatgatcatacagtcgctctctgggaagtggggagtggcggtgaccctacaaaaccagtacgaacttggaatgatttacattctgatattattaatgataataaatggcacaacttcaataaagatctattcggcactgtttcagaagattctctcttaaaaataaatgacgtcagggcaaacaatactacgatcgatactgtgaaatgcccgcaacctttcaacacattagcatttagtcatcattcctcaaacctccttgcggccgcaggtatggactcgtatgtttatctatatgatctaagaaacatgaaggaaccattacaccatatgtcgggtcatgaagatgcagtgaacaatttggaattttcaacccatgttgacggtgtagttgtatccagcgggtcagacaatagattgatgatgtgggatttgaaacaaattggagcagaacaaacacctgatgacgcggaagacggcgttcctgaattgatcatggtccacgcaggtcacagaagttcagtgaatgattttgatttgaaccctcaaataccttggttggtagcaagtgctgaagaagaaaatattttacaagtttggaagtgttcccatagtctacccatcgtgggaggtccaccaaaggtgaacaaggatataataagctaatatatagtttctttattgtttctttggcgaaaaggcgtaattaaacaaagatcaacatacataatccgattttgaggagtgataaaatatacttagattattccttatccattacagtttgcttttttgaagatagccaattgatgaaatcaataaaaatgttaggtccacattttcctttttgcatccactctttggtagttgcagtatacaagtcaatcaattcgtcaagcttgtcgttaccaccgatttcaacgtataacttactcaaaaacagtgagctggttgagcacattgaataaaacactgcagcatgctgacctggcttagaagtcagcatcagcttgtgtgtttttttcaacaaatccataagctcgatgtctttgttcatgtctttgaatgcagttacttttatcttgaatattttacccttcaacaatttagaaattttgtcggcaagtggcctatcaagagtttcattgacacatttcagcattgggataataaaataaacgagcttgcttaatgagcctcctaaattgttggaatgttcacttttattagcaagagtcaatttttcacaatatttgacgtaaacggctaacatgtcgacaactctatgcttgaacgagataacgttttccctagattgttttacctcaaatttcctctggtttccagtagatatgcttgataatgcttccttacgacgtttgaaaatttcggataactgatcatctaattccatcattttttcatcatccatagactcctcatcttcatcgtctccaccgtcgtcagaaagcccttcgagttggtctaagtcaacttcccctttatcattaactatgttatcgggtaaatttaacgccttcactaaggcgctagtggcctctttatcaatattcaaaatatcttcatttgcctcgtcttcttcatctttttcatcagcatcatcgctatcactctcactttcactttcactttcactaccagttttcgattcgtcttcactggcatcattttcttccttaatttcttcaaattcttcttctccttcgaatagctgggcaaaaccttgcttgttttctctcgcttttaaaatatctaataaaatttgcaattcttccaaaccaacttcttcaataaactgctgccagattattaaactcaatttcctgagtaaggccttcttttgggctaaaagtgatagtaagatttcagtgatgcctaccattgagttattctcgtgtttggaaaattcgcaaagttcttcgatcacagaaatagaatcggtgtcacctgcatataattgtactaagcacatagataacaacgtgcttagaccccaagattgagcagttcttgatctgcaaactttactcaagcaagatatagcttcgttttttatattttctaaattttcgtccagtggattgattaaatctcctacatgagaattttcaatgtccagtattaactttaatgtcagatattgccatgagtttatttcaggatctttgcaacgtatttctttgtttattgtcaactctcccaggatggaataaagtctttccttggctaattcgtgtagctgttctaacttcagatcatctgatgtatgtttgaagaaagccatatatacgatgggtctcaacacgggcttcattatgtccatgtcattgatttcgactttgtgtgcacgaactatatgaaggatggaatcaagagcaaaaagggtatgagataaaactccctttttatcttgtaactgtagaaaaaacacatcgagtaattgggcaagaacagtagaaggtaattctttaattgcaataagtttggaaacggtgccagattttgttaacttatcaaagtttatggaaccgtgaggaccaaataacattgcatttaaacaaggtactagtctgtttgcagaatcttcttcacaagccttcactatggagtctaaagttaactgggaaatcttatttaaaactctttgtgaatctattgattggttgatcaatgttctcataacgttttggctgaagcaaaacccgatgtacgagccaggaactgccttgaaagccgcgtcgattattagaaagcctaaatattttctttcactagaagctttctcattgaaaaatgattcgtccacggccattttccaaaactctggaaattgaattgaattctgaacctttttattgttggttttcttccttttcttcgaaatatgactagtgttctctaattttccattaccaaacaacggtagcagaacactccaaacaaaatgcagcctagggttccaattcgtgtttttttgttttttcgtctcttttaaacctccattggcatccggaattacagaagagtttctcaatacttttgttaaaaggggcagatttcctcttgccagagggtcgttatccttccaacctggatttttcaaatccaacaccgagggaattagactttcatcaccttcatatttcagcaacaaataagttgacagtccctcatttgtcagagtcaggtcatatttatcatatatcagaagaattttttcagcggaactttcatccataaaaggtagcagcattttcatagtctggaaaagggtaaaaaagcatggttctttgatccagtttttcttcagggccagatcaattagctgttccgtgaatcgaatgaaaaactcggtgtttcctttttccaaatctttaacaaatatttctgagaataaaggttcatttagtagagatttcaagccaaataacttcccaaataaaattccacgctcatctttgcccttcatggatttttttgttccctcattgacattaacgttcaaaatggttgataaggtgctcaagaactcgttcgttgattctaaaccttttggtcgttgacctggtggcatattaacagctaaattgattacttccgtcaaacataaagaaaatcctaacctcgcgctatttctgtcagacgacaaacccttgattaaacgattcaatacataagaccattcttctgcatcgtcgggcaaatctaatgcggataagtcctttattaatgcgacagctgcatgtagacgctcttctcgaagatcagaagctagtttaaaaaaaaggtctctgttgactttccctgtcattttttttgtggacaaaaagatgcacttgtggaaagaatcacccttgttaatggatacccgattcaaacttcgaattaagtgcaaaccgcagcctcagattaatgttaaattgccctctaaggcaattctggccatcgcaataaaatttttcgtgttattcacgctttaaaggccgggtaaaatgatagcgtccgttgattttgaagactattacttttgcggatattttatgtccggtctatcatatttaccaatgcaaaataatattttgatagtttttaccgcagaggcagccagtaagttgggaagttgctcagacccatagatacatacgcaggaaaggttttgttttcctcctttcattattgcaattaacgtatacataacttgaaaagctgatgggtgtcaagcacgcccatcagcgcatctgaaagtagccttgaaggaactgtaagtttccacttttcgaatcagttattggtcgtcaaccattagcagaagtaagttcagatatttagatataccctccctcaactataacgattaacaagtgtttacgaactaatgtaacagaccaatcccaagagagtacgtactaagagaaaatgtaaggctatgaaatggactaatataaccatagtagaaataggtatatcttagtgagtaatcgcctaaattaatcttgtttgcaatataaattggaactaagtacagtgaaagacatcgatggaaataaaaaaataaccatcgaaacttggtcccagagtgttgtcaaacgttcaagatggtttcttttctaataaaaagcaaattagaaaactatttcacaagttagtaataatagtaaagaatcaagcatggaaagcaaagtaagaaaaaagaatgaagtgaaaagcaaaaaaaaaaaaagataaaaatgaaaaaacaaaaaaacggagggtataatcacatgcagatataattttcggaaatacattatagaaatataatgtgtcacttatcctcttcattgtggttatccagagaggaagagaagagacaaaacagatagaaaaagtataaccctagaatcgaaatcaaaaattagaaaataaacgtattggaattttgtgcaattatcatattaaaatacaaaaacaataaaaaaactaaaaagctttgaaactttctttaatttttttctaattttctgggatttcgatttcaccagcattaatgccttcaatgatatcatggggattcttgaagtcaacacgacagccgacagattgagcagtacctaagatttccttagtaacggaagccaaagttctaccgaaggatttgtctctcatttgtctggcaatttcaataatttcatccaattgaatgttaccactgtgcttgacgtttttgtccttctttctgtctcttggtggttccttcaaagcagtaatgaccaaagaggaagcagatgggacaacagaggcagcagcttgtctgttttggatctttaattggacggtaaccttgatacccttgaattctttggtggccttagcaatatcttcaccaaccttctttggcgatagacctaaaggaccaatctttggagccaaagcagcggaggcaccgacttcaccaccaacggctcttaggtacaagtatttaacttcattaggatcaaactttggaggcatttttgtatatcctttgttcttgttgtcgactttctagaccccaaaagaaagttcctttaaggtgtaatagtaacgaactgtaactcaaagaagccttgaaatttaccaaaattctagactttgaataattttttcagtattaggagatgtccatttccagcagtgttaacggattccaaattttcttccgggattttcccttcggttaccaagagtgtctctccagctctagggagagcccaggagtaattgccgccgcgtccgcctaagtctaggcagcaagccacaactgtacggacggaactcccagccaagtaagtttggcccgaactcacaacgggggaacgcactgcattttaccagcttacaacaataacgccgttgtaggcggcttgtaggtacaatcgcaacgatatctggagtagatggcattgaaattgagctgatactgttatagtttacaagcagtacattgtctcattacattgtctctttgtttgacacccacacatatttggtgttcggatgttaaacagggtatttatcttgttttagactggtacgaatgggataatggcataaggtggcttcatttgtttgagtataaaggtctcctttataataattaaatagcgggtatataatgctaaatatattttgtacagttagggtaaattccagattatttatagcggtcttgctttattctcaatgtttgtatggggaaatagttccatccttctgttgtatgaactaattcaaccttgtattcgtgggagtccttgtttttaatgttctttttcaaagtgttgacgataacttttgagttgactgataatgctttagaagtatgttttagtttacaatagtactccagagagagctcttgaaccagtcttgttcctgttactagaacgccgttattatcgcctcccttgattccttgcattatctcatcaatagaactaacgacattgcgcacttcagtttcgataaagttagtggccctttctaactttatatcaaatgcagctcctttttcttcaatgacaaaatcttttaaagtttgttgaaatacttcatattctggtaactcaggaacaccaattgaattaaatggcttgaatctcaaattatggattaaccgttcattagagaattttgacggagtactattcttgttgtcaattaaaccaaatgactttaaaattgcaaattggaaaacctctattagacataaagatttggtaatgttaatttccttcaaaagatagtttaaaaattgtttggtagcttgtaattgttccatttcattatccatagcaaacctgtactttagcctcaattggtccttcttttcaccagctttcaattttttaagttttttgttcatggaatgaatggcattaatatttgattcaatatcattttgactatctttcaaaaaggtttctaagtggtgacttaaataataaacataccaaaacatagagtatgcttcaaagggtttgtaaatatccaaatcaaacccctttaaagagaattcgatcatacttgatagtttcataaaatatgtccacgaacagtaaacttgtgaattgacactttcaaactgggcttgaagagaatcccatagaataagttgcctgttaaaaccttgtctatatctacatgtgttttgggagcagttttggtaccattctaaaagcatattagagctttcttggataagttcattaccaatagaggattcaaattcagatggagtttgtgctgaaaactccttgacatgtagcaaataaaattgggtatatgaaaatttacccaaaactgttctgtcgtctctaatgaaaaataaggggaataagatccttgcaatgacatgcctttgttccaacttgttgaagaatttggcaaactggtaggtctccaacgcagactcggctttatctacaaggagtattgttttaacatcatttgccagtgtaataaagccgctgtaatccgtcggtaacttcgtaatcttcctgggagggaattgattagacctgtgcttttgtatatatgttgagaacgcaccctttggtggagacagctgtaattgtggaaatatgccattaaccgagttagcgttttcaattagctcatccaggtggcttgtctttgtggaatagtctgtcagatggtcttctaagtggactaagcaaatgataatttttagtatatgcttcagcatagttaaatgtaagctatcatcagaatatgcctctaatatctgaaggctctcggtgagagaattgataacaacatcttgccccggcaaattatcgaatgtattaaaccccatgttattaaaatttaaatcctcctcttcaaaaacaataccagcactcaagagtttctgcacaaattttgttaaataacaaacgccaagtatgcaacttcctagtactttatcatacaaaatattccctgtacaccaggacgaaccggcagttgttcccttaactaatgacgataataagctttctgtatacctgcagcttaatacagtagtgggtaaagtctggtagtcattcagccaggagataacacatctaagtaatctatccgctatggctgctacacttgccaacggtggatcgtaggccacgttcacatcaaattctatttcttctgctgtcaattctatcagactggagtctaatttggagttgttgacctctaaagaatgtgtaccctcgaacaaatcaaacctgggatctttcacgatagcctctggttttagttttgaacacaattcatcaaacagacttgtgacgtcaaccaattggtcaaaatcatcagttatgctcaaggaacctaatatactgtctacttccattctcggaaacgtaccagctattatcaaagttgctctacactagcacagttgttttcaatctcagcgccactcttcttgctattgaagagctgctattttacttgtatctcttcgtgaaatttcactccatctcataattattacccgaaaacataacaatgtgaaataatcgtattatgtaaaggttagataatataacaactactagataatacagtactcttattcatttatttaggcacctgattccactattacctattcaataggtgtgccgagttcctttgtcttacgtaattttacacatcttttatgggtcatatttcgatatgtaaggtaataacgggaatctccggatttactttaaagtgggagggagaagttcctttcttctgatttgcgggtgctccgaaagaacaaagaataaataggtaaagcagtgaaacatagtatttgctggttaaaatcatgatcgctttgaagcccaatgctgttcgaaccttccgacaagtgcagcattgcagctttcgcatttgtcggtatcaatctacgaagtcaaataagtgtctgacgcccttgcaagagtacgacagactggtgaagttggggaagctacgggatgatacatatcagcgtggtatcatctcttccttaggggatttgtatgattcactggttaaatatgtacctccggttgtcaagacacccaatgctgtcgaccaagttggcggttggttgaatggtcttaaatccgtatttagccgtggcaaacctaagaacattggggcgtatgtggatgtatccaaaattggtaactcgatacctcgaggagtttacctatatggagatgttggctgcggaaagacaatgttgatggaccttttttatactacaattcccaatcatttaacaaaaaagagaatacattttcaccagtttatgcaatatgttcacaaaaggtcgcatgaaattgttagagagcaaaatttgaaagaactaggtgatgcaaaaggaaaagagatcgatacggttccatttttggccgcagagattgcaaataattcgcatgttctttgttttgacgagtttcaagtcactgacgtggcagatgcaatgatattgagaaggctgatgactgccttactatccgatgattatggtgtcgtacttttcgcaacctcgaatagacatccagatgagttgtatatcaacggtgttcaaagacaatcatttattccttgtattgaactgataaagcatagaactaaggttatcttcttgaattcgccaacagattaccgtaagattccaagacctgtgtcctcagtttactatttcccatccgatacgagcataaaatacgcatcaaaggaatgtaaaacccgtcgagaaactcatattaaggaatggtataactatttcgcacaggcttcccacaccgatgattccactgattcacacacggtgcataagacattttatgattatccattaactatttgggggagagagttcaaagtccctaagtgtaccccacctcgagtcgcgcagtttactttcaagcagttgtgtggtgagcctttggccgcaggagattacttgacgttggcaaaaaattttgaagcctttatagtgaccgatattccatatttgtccatttacgttcgtgatgaagtgagaagatttattacatttttagatgctgtatatgacagtggcgggaaactggccactacgggtgcagcggatttttcttccttgtttgtggaacctgaacagatacttaatgattttgagttacgcccaacaaccaaagaacctgatagcgtcgatactggtatggtagatgagatggttgagaaacacggtttttcgaaagagattgccaagaaatcgcagatgtttgctcttgatgaagaaagatttgcctttgcccgtgccttaagcaggctgtcacagatgagctccaccgattgggttactaagcctacatactaaaccctatgtaacaaaagtgtttatttatattcttgtatttattctaaacacgaactttgatcgtctaacaattgccgcagttacacctttaacaatagtgctttttattactgatattactcacctgattttttgttacccgaatgcaaatttgattaggaacggggattgttaaaagacaatggcagtacagataaaggttagatgaagcagcagtagaataaatcagcatctgtagtacataggttcctaacagcattgtgaaaaaggttcaaaaatgtctggtaatagagagcaagtctttcctacgcgtatgacgctgggtttgatgaagaccaagttaaaaggtgccaaccaaggttattctttactaaagcgtaagtctgaagccctaacaaagagattcagagatattaccaaaagaattgatgatgctaagcaaaagatggggagagttatgcaaactgctgccttttccttggccgaagtttcctatgcaacaggtgaaaacattggctatcaagtgcaagaaagtgtctctactgcaagattcaaagtgagagcacgtcaagaaaacgttagtggtgtgtatttgtctcaatttgagtcctacatcgaccctgaaattaatgatttcagattaactggtttaggtagaggtggtcaacaggttcaacgagccaaggaaatctattcaagagccgttgaaactttagttgaattagcctctttacagactgcatttattattttggatgaagtgattaaagtgacgaacagaagggttaatgctatcgaacacgttattatcccaagaactgaaaacacaattgcttacattaacagtgagttggatgagttggacagagaagaattttatagattgaaaaaggtccaagaaaagaagcaaaatgagactgcaaaattggatgctgagatgaaattgaagagagatagagcagaacaagatgcttcagaagtagctgctgatgaggaacctcaaggtgaaacattggttgctgatcaagaagacgatgttatattctgaagtttcaggcagaacaagacccttttcaaaaatatgtaagccattattaaaaaaaaggatattttgtataattgtttaataaaataacatctttttaaacaatcataaatagcacttcttatcatacaacctcaaatcatatcggtccaaatttgctcaaattgtacatgagatataactttttcttctaatgctttcatttcagagtttgtttttttttttcttttttttttttcctttaccggagtctgaatctcttacttccttaacttagatgttagtgactaaaatctgatggacagtatcaaaatgtaaatattgtacctaaaaagaaaaaagtattaaagtggtttgccataaattttaaacaagtgaaaagtttcaatatttatatttacatgattgtggacaagcggcattgtctacaggctgtgcaaaattatatagtacagataaatgtaaccagaacaacgaagaaaaggtccctatgttgcttcttttctactaaaattagcctatttataatcttgcatctttgcctcttggtctgtcttttactttcattctattttgatttttaccccttctagtcttgtacccctttgccagttgtccccatggagacattgataatttattagacttggatttaccacggccaccaccgtgaggatggtcacatttattcatggcaacacctctaacagtgggtcttatccctaaccatcttgatctgccggctttaccaagagatctgttttgatggtcaatattggagaccacgccaatggtagcgacagcctctaaagacacataacgatgttcaccgctttgtaatctaacaatagctttctttttttcaggtaatttcgcaaggactctggcatatgtaccagcagagcgacaaaattttccaggtccaacgggtgttatgccaacgttgtgaataatagtacctatggggatcatggaaataggtagacagttgcctctttgggtagtcttaacactcaagatagcagggtctactttcccgcccatttcattcagtaaagtttgaggaatacctcttctgaaggattcgaccacatcgcctgggcgtaacccatcacaagcaataatataagacaattcgccggtagtattatgcttcaatagggcgatatgagaggatctacccggatcgtactcaatcctttgcaccgtttgtgcaccaccttcccatctgttaaagtctatcagcctcgttctatttctatggccaccaccttggtgacggacagtgatttttcctgaattatttctaccaccgtgcttctttcgaacaacagttagggctctaaccggacgacctttgtacaaatatggataaatgggggaacggtaccatctcaaaccaggtgagacgggttttagcctcttcatctgggtcacttctttcgaaagtttacgacgtcttttaatcaattcatcctgcttctcaagagtcacgatatcagtatcgttaggtataatctttagtaatcgtggagtaatgttcaaactggagtcatcttttgaagtattctcttgccacaatttaacactctgagatagagttcgacagagtataccgtatggataacaagggtttctcttactaataagcgatgctgtggaactgcacgacagcgccgatctaagagaccctagcaccaacatctttcataaacacttaaattatcttctctgcgtatttctggactagtttacaacgttctcttttgcttagttagaactcgctttcagtttcccatacgttccctttctctttcaattataggttcaagccctaactttccacctcgcgtagtcttttttttgcatggaaaattttttttgagtatttaaagaacagaggttctattcaaatttaaccgtagaatatacttattcatcttaaataccaagcgcttcaacctgtacgtggatggtaacatatagatatttctatagaatgtgttaaggaacaggagttcctgacaaacaaaaatagatcgtactaatactttttttttcgaactatactgtttgcgtatgcttataaagccaagagggggatgtttgtgtattactttctttacttttttctcttctgcattattgttcctttagagatgataaagacaacttacaagtacagttttttgttggtatctcattaacatgatgactaagttgtcgccccaagcggatctttgaaatgactgattttacaaacaacaaacactgaaaattctgaaattaatgagatatttacacattaaacatcaaaagttttctcaaggaacatgtatttaatgcaagaaaaggattgctgaagaaaggaatcttttctcaaacattttacctcttttgcctcatttgtacacagcggtacggttggattaagaaaaatatccattcgacctagttttttttgttaagcacaatttggtttcaatatcaattcttactgttatataaaaaattgtcttaattgccattatcactcctctttttttttttttttgatgatgattacactccatgctaatcatgaacgtgttcgatgtaaatttgaatacgatgattaaaattgttgtttacgctttctgaaatctaaactagaaaagaaaaggaactatcaaagaattaggctcttcgtattggaattagttgacagttgctcatgaaatgaatggattaaaaaaataaagctgcgcaagcccggaatcgaaccgggggcccaacgatggcaacgttggattttaccactaaaccacttgcgcttactatttgttgttattcaaaaaataaagaacccacagaacatagattagaacataaccttggagtatcaacttgattcacaaaatattattcgtcgtatatcatggcatatagaatcttgctggaataagaagcaagtttcatctttgatcttatgtatatagtattaatatgtattattgttggaataaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttgacaaaaagtacgatgggaaacagctatcaaatttaaaggaagctgaaatgcaagaattaataatgtaatagggtagcgaacgacaaagtataaaaggaaggaggatgaagttacataattatgtagcactatcgacttccttttgggcatttctataatctcgaggaaatcttctagtatatcctgtatacctaatattattgccttcaacacagacggaatcccaacaattatctcaaaattcacccatttttcactctcaaatctgaatctaagtaaatagtggcagtgaaatccggatcaaaattcagtaacttttgtgatatctcacattgacataccacggtcggaggtgaatttcttcaccattaacatataatatgatcatctatgtaaattttattgctgttattctattagtagtaatgatcgaaaatagtagaggtatcaacgaggtcaatggatcaaagaatgccttgaacctggttagtctataaattttcgtttacctacgtatgtcatattcaacgttctttctttctcaatttctgcaatgatcccaccggagtatatgaacgaactattttatcattatagctagctctaaacggctgcaaaaactaattccttgaaacaatgtgccattaattatctaacgcgtgcttcgtcctactgattattatcccttattcgtttgattcacatagtagacaactcttgatcacccatatagtaccagacgacgctaattcaaaattaatcgacattacgcatgtttctaatttgggaaaaaaaggccaagctccgatatcccgtttaaggtcaacgcttgaacagtggtttctgaacgaacactcatatcatattacttcgactcaactgctgagctagcagactggaaatatttcagggactcaaaaaaggttcaactagtctccactgtaagcacattcttgcattctgaatatacgaatgagtatcattaactcaaaaccgcgccctcttatacgagacctccaaaaatggatcgttcatgagtaaaggcatctcaataacaatagcaataacaataatgttcatgaggtgaaaggtggcccctcgttcatgtaagagaagctggccgagaaattcatataaattgaactgctttggttacctctctttggtatatgcctccactcttctcttcctagttaagcttatatcagcacaaacaaaacaaataaaatggtcaaattaacttcaattgccgctggtgttgccgccatcgctgctactgcttccgcaaccaccactctagctcaatctgacgaaagagtcaacttggttgaattgggtgtctacgtatctgatatcagagctcatttggctcaatactactctttccaagctgctcacccaactgaaacctacccaattgaagttgctgaggccgttttcaactacggtgacttcaccaccatgttgactggtattgccccagaccaagtgaccagaatgatcaccggtgttccatggtactccagcagattaaagccagccatttccagtgctctatccaaggacggtatctacactatcgcaaactagagacaaacgccaatttaatgaaggaaatgctatgaaacttagataatgaaataaaaaaaaacccttttttttttttggtagtataaatatctttatacgtacatacgtgaacaatcacatcatatctgtcaattctcgttgtaaccataacctagcacttatttcagactttccaaaggtcgcagtatctttatgacgagccatcccatgtaaaaattgccgtgccggatatgaagtgacaaagatcagtctatatctcggaaagccaacaaatatcttcattatgaagtaacgtatagtgattgcttccacatctgttcaattcggacaattttcgttagcagtagagtcaaagcgatcgccttaattgtctccgtatcttatttattcatgaacagcatgacaattgacagtcacttgaatgaagtagaaagtttgattgtcacggtcatctgagatatactaccggcacctgatccccgctaattaggcaaggcgaaactgtcaccaagttggacatattagacattaataacttctctgaatcgctctcactccaaagcagtgacattaaattttgctttcattcgtgaaagaatcgactaataaattatcatttataattcaacttcagttgaaataaacaactcatcaaattttctttccaagctttttataatggacttttcgtcaccgctaacaagtaaaggattacatttgacacgtatatagatttttcttacggtttcgaaaatctgattgattgcttcaaattcatcatcagctccacttaggcttttttgttcaaatccaatgacaatcttcaggcccgtctgcttaatcaacatagcaaatacagagacaccttccaattgaaaaattgacttcagaagaggtttggaatctaaagaatgccattcaaccaaagcactttcaaaataatctaacgatatgttagaaagcacgttatatttgagtacatcattcatctcattctccgcctcattagggacgtaaatcaatataggtttatcagattcatctatcaatgatacgaagcaaggcctcaagctcatagtttggtgatataaacgtacaatttgatttttggagagaatatttactcaattttcaactcaataacttttatgtaaaatgtttcttggccgtcgatgagctcttccggcagaacttcgaaagtagaaaaaaaaaaaaaaaaataataataatattaatactacttatatactattaaaaaatcgtttagaaatgattcatttataaaattcgttacttgcggtcattggcaatagattcagctgcggttctcccaaagacaacgcattctaacaaacttgaaccacccaacctattggcgccatgaacaccgccagaaacttcaccggccgcgtacaggccttttagtagcctttcgtcgttcttgccaatgacttgagccttgacattgattctagcaccacccatggtgaaatggacaaccggtgttacttcaccaataaaaaccacagtttctggagtaacgtcagagccaaattcgttgagaataacggtacgtcccaacggatcagccttggtagtgaaggaagagtatgtttgcaattcctcgcataattgggcgacagtgattggtaaattatattcagaaacaacttgagataatgtcaatttctgtacaagtttcttgaacatgtaaaaatctaaattattcttcaaatctgtgtacattttttcgcccataaccaatagtgctctgttatcctcttgaggacaaaccttttgaatagctgcagtgactacatctcttgtggtcaattcgttgacaaatcttctaccggtaatagggtttaataggataccaccaagacctcttaaggattcggcagccaagaatttccagcttgagctacggtcatttggatcaatgaacccagttggatgaacttgaatttggtccatgtcaatcagatcagcgcctaacttctgcagaagcctttgaccatcaccagttgtttgttgcccgtttgttgttggcaagttcaccagttcgggtgcgtattctttaagcatttccttagaaaagccaaaccctccagaacaaaaaacgacatcgttagcactcaccatgtgcttttcgccattcttgtcctcgtacactacagcagaaatggagccatccttttcatggatgtctacgactttactgtctaagttaatcttaactaactctggtttagtctcagctaatttcttcaaattgttagataaggcagaaacaatttcgaaacctggaggcaacttcccagacgatctgtgagttcttgccacagagtggccacccaattgagccaataggtccaatttcaaatcaaattcgtttttcaaccattcaatagccaggggagaatcattggccaacttagccattaattcttggacacctttacctttagcagacttgatggtgtcatcttcaaataagcgtggggagtcctcgatgtggaagtgacgttgagtctcggtgcaagcaccgttaataccactggaggccttgatagagttcccaccgatcgaggaagccttttcgaggatggttacagggatgttatacttgttaaccaattcattggcagcagccagcccggccaaaccggttccaataacaacaacgggagagagagacatttacaattacggatgaggggttgttgaagtgaagataagaaaaaaaaatggggtgctatgtcagcgtattgttctcagcttttatacgtgcaatagattaagctgttcaggaacgcgacgcgttgcccccgttaccgtttgaaaagaaaaaaattttctttttcatacctgtctctattgtttcagtcattcactgcatgatgacaaatgaaagaagaaagacaatagtagtaaaagcaaaaaaggaattaaagtgaacgttttttagactcttacgcatacatataaatatatatatatatttgtataaaaggtgtacgtcgaaatcctgtgaagaaaccctgcgagaatatacatgggtacattcaatcttaatacgtagtatcgtagaatacaaagaaatgtgcttctccacgtggatacgtaccgttgtaaactttaatcaagtaccaaaaaaaccaaacatattcagtcgatctctcaatggggaacaaagaaaagaggttcttacctttttttcctccttccctcagaaagaccaccttcgtccctccataatagggtagttagtcgctaggtgcgctggaaactaaccattggttctcaaatgtgccgacataattagttataattatggtgtgagagttgaaatatccttgaataacaaaacagaaaaaagaaaaaacccatttgaatataaaaatcattgatgcaaaagaaagccgttaaatctacaatgccacgaaattattgtaatgtatgaaaaaaaggaagagggtagcaatcctaaaacaaaaaccctaacaatacacatgatgcaactggaacgcatcagtatttgtaggtttttatttcgcggatagcgttgccatcaacgtcgacctcggtggattcactacggtaaatctgggtaggtccgttacagtcgaaaggatgttctttagcatagtcgaaggcctcggagatggccaatttgactttttccaaagtatctctggtgacttgatagtggaacgagactctaccacccattagcttaacattgtacttcaaacccttcttaacaaggacatctgggtccattctagcggccttcaggttaataaagacaaagttggtgtctgctggagactctagcgggatgccctttgcctcacaatattcggctaattcatgagccaaagagtgcgagtacagcaattgggacttccaatcgttgttgatgtttacaagagccattctagccatcataccagattgtctaataccaccaccttgttgttttctgaaatgggtggccttcttgacaaacttaaggttcccaaccaagacggacccaataggagcacccatagacttggatagacagatggagatggagtcgaagatttccccatattgctttaatggcacgccagattgtgcagcggcattccagattctggcaccgtcacaatgtagtttgagaccattttccatacaccaagctttgatgcggaccagttcttccaatggataaacaataccgtgtaaagtgttttccagagaaatcaatctggtgggggcaccgtgaatatcaccgtcgtctgggacgtagtgtgacttgatgtcttccaaggtcaagtagtcaccgttggaaggaaccacaggaaccaccatcgcttgagacaagatcgccagtccagcggcttcgtgagtgtaaacgtgagccctgtaatcacatagaatagagtatggaggttgcatcaagtgagttctgatggcaatctggttggacaaagtcccagagacacagaacaaacctgcttctttgccagccatgcgggcaacggtctgttcgagcctgacggtgtcaacatcttcaccgtagacagcgtcaccgatagaggcctctaaagcggcctgcatcatctctcgagtgggagtggtgaatgtgtctgaccgcaagtcgttagcagcggtgatatattttggaggcaattcgaattcagtcattgtgtttatgtttgcgtttgtgtgcgggagtaaaagtgagtgtaagcctaggaaaggaggtggttacgaactagccagcggaaacaatgtacgtatatgtatgtaagtattactctataccagacagaacaagatagacgagaaggacacatggaggatttgacaggcaagctcaacacttgcttatatatatacacatatgtactattgcaaatgcaaaaagcgtatatccagtgaagaaaaagacgaaaaaagacgaagaaatagaaagaaaaaccggtgaacgaatacggcaagtgaaaaagtgcgcaatgagtaatacaaagggcgaagcagcgggaaaaaagaaacggcgctgctgccccggaaaccggaagcgaagctttgtggggtacgggtgcatgctcggcgttttcccgataggggaagtgccgtcgtcaaaaaggcaagggttccgttttgcgtgacatttcatagcgggccaagcgtgggtcacgtgctgcacaggcctgccgctggtatgatttgtcagcacatatacaacaagaagtattggttgcgttgaagaaaaaaagaatagtaataacaatttggggccgtgtgtaaaaaaaataggaaacagctaccccggcgtgccgtgtggctctctgtgcgaaggaaggccctgttgccgcacacattcgatgaatatcgatgacgacgactaccttctggttgcatagtttattagtctgtgcctgttcttcggcgagtgagtagatgaaagaaagaatgagtgagagagaattctaggccaggttcggcttagttaagcttagcttactttgggtttacttagcgtgctttttttcttccgcgctgagacggtgaggaatggaagtgtaaagaagcgaacgagggaaaaaaagttgtgacctaggggaaggttaaaattgtcatcatcatcagcgtgagaaagtcgaaacaatgagcggtagtaggggcaatagcagcaatagtagcgtcagtaataatagtaataataacaataataatgacgggggcgacgagagattgctgtttctaagaagcgtgggcgaacgcaatgaaattggctttccctctagattcaagtcggcgcattacaagaaaccgacaagaagacacaaatcagcgaggcagttgatctcggacgaaaacaagcggatcaacgccttgttgaccaaggctaacaaggctgcagagagttctactgctgctaggcgacttgtgcccaaagcgacgtactttagcgtggaagcgccaccgtctatcaggcctgccaagaagtactgcgatgttactgggttgaagggcttctacaagtcgcctacgaacaacattcggtatcacaacgcagaaatctatcagttaatcgtaaagccgatggcccccggcgtcgatcaggagtacttaaaattgagaggggccaacttcgttctaaaataggcattgtatatgtatgtatgtattttagcttgtagacaacctttcacacttacatagtttgtcgctggtcacgtgcgccaatgcaaaatagtgtagagtaaagctaaaaaggacaagataaagtgaaaaaaaaaataataaaaaagaaaaaaaggaatattgttaatggaaagcgtgtaaagacacattacgctcctacctaggactaccaacacatgcatggatgccagcctctgtaataaccacggttttagcatgtctgtggctctcttataggctctataagtttctcactattcctgtgtccagcatcgtctccactttgaagatcaaaactccaccggcaacaaaagtgtctatcgacaaaatagccacggattcagtgaccattcattgggagaacgaacctgtaaaagcggaggacaatggcggtgcggatagaaacttcatttcccactatttgttgtatctgaataacacacaattggctatcttcccaaacaacccaaactccctttacacatgctgctccatcacgggtctcgaggcggagacgcagtaccagttagattttataacgattaacaacaagggcttcatcaataagctaccctccatttactgtatgacgaaggcgagagaggcgaatgaagcgttgaagactagaaaatggagaagaaacaccatcacatcgtccacggctatgcagcccagcaactccaagtccgaactcgccccgttgctctctcactactcctctgtttccctgtctactttctcatccaatattactaatagcaccaccagtaataatggttcaaatctacccgcttacacatctttgactacgttgaaggatttggattcgttttccatcgatgatctgaaaaagatactgatttgcgcccaggaggacttacacgatgtcttgtcccaacaaacctcgcttttgcaagattttcaagaatcgaagttagaattagaactagaactggataacttgaaaacacattggtcgcacgaagttgacttgcggaaatccttgaaatccaatatcaagtcattggagaattctaaactattgaccgatttgaaaatcgaaaattgaacaagaaaatcgacaaatccaaggaaaaatatcgaaaatgcgcaatgatatgcagaactggtctcaggaagataccgagctgttgtctaaggataccataaaggagaaatatttcaaattactaaacgaatccaatgcctctgtggccaatatcaacaaggaaattgagtctttacaaaatgaaatttccaagatggaggagtctaacaagagattgaacgcctctaagaaatcattgattacttccatagtggtgaatgccaatgtggaaaacgataaacctattgctagcggagaattgtcggctgttttgaagaagctcaatgattttactttagaaaaaaatggatttttaagtaatgctggtgaagagtttctatccaaattgaatgcagactcatcattgattaaaatgattaagaaagagctaagcattgatcaagaattggaggccaactggaaattgcagaggtcaaagttgttgaagaaaattagtgctttagaaaaccaatttaatgaaatgagccttaataatcggaatttgaaaacaaaattaatggttcaaccatataagaataacggtgattcgcttgctgccaccaattcaaataattccgcggaaaaaaacagaagttctggatcgattcaattgccattatccaacaacatgtccagaacggggtccattgatttaatatcgaataataacaaaagtattaacaacggtaatgctgattctgctcctccgttgaggttgcacaatccagtttcgtactctccttcgaatgaacccatacaaccttcaagcagtctattgagtcaattgacacaggacaccgataatcgatcaatgctctccaatcacatctcatcgaacaacgaaaacaagcaacagccttcttcatattcacatgctttacctacaactgctactgctaatgcaacagcaacagcaacagcaactaatggtcactcaaggtcaaatttatggaccaccgcacaattcgctcaaccttcgcatcaacaagtatctacagaattggatcaagcttttgaatacgataatgcaaaccacttaatcagtggtttgcaaaatatgatctacgacgaaacagactatcctgataacataagcaattattccaagggttttactacagacgaacttgacaattactggactaagcagcaaccccaggtgcgcagcacaaatgaaagtcttttctctacgactggaacacctatgtcatcatataaggctaacccagtaatatctccatattctagttctcatttgcgacaaacctccaacgcaaccaatacgaatccgatgcatccacagagtctactcgccgctacattgaatgatccttcattacaaagttttgtacgcagtggttctttctacagtgctccgcaacctgcaaactccttagagaacaatatcaatggcaatgaaaccgagaacattagtccaaggatatcaagtgacttcaatttattggtgccaaacttgagcccacgactctcaaacgatgtgcccattgttccaggcaataacactactttaacacctttacactcgaacatattaacaatgaaccatcaaccaacggcggataacagtacacgaagatcattccatgcctcttcaccacctttcaactccatatggaattcaaatacaaatcaactttctcctccattggaggagcagtatcacctcgatgtgcctgtgggtccaaaggttcccgctaaagaaccaaaccctaagccttctcacaagaggaaccaaagtaacagcagcatttcttctgcatggtccaagtttaagcacaagtctgcatcatcacctgctaatgcggacacggatattcaagattcatcaactccatcaactagtccaagcggtagaagaatgtcaaaactgttgtccaagagcggtatgaataatctatttaacccgcacagtcacgactcatgaacaatattataatacttccaggtcgtgtatatatgtagatatataaattatgaaacataatatatgaaagcagcttgagcttattcttaatcatcaatagggtaacggtattaatctcattttttcttttttttttcttttattttggcgtctcgtctcaatttcatttttcccatctttttacaacttcaatatgaaaaacataacacatgaaaaataactgtcaacattaataatattctttgcatactgcttcgattttccaaatataaaaacagtttcttttacaagcttatttaattttggttttaaggagaaaacactaataaaaagggtaaggactgcaatcaacaatctttattggcgaacagttaagggtcctctcgagaagaaacattaagacatcatcgcacaaaaaacatggcgcccatctttagaaattaccggttcgctatcggtgcttttgccgttattatgctcattttgttgattaaaacatcttccatcggtccaccttctattgcacgtacagttactcctaatgctagtattcccaaaactccggaggacatctctatcttgcccgtcaatgatgaaccaggttaccttcaagattcgaagactgaacaaaactatcctgagcttgccgatgctgtgaagtcacaaacaagtcaaacatgcagcgaagaacataagtatgttatcatgatcgatgccggctctaccggttcccgagtacatatatacaagtttgacgtctgtacttccccacctacattacttgatgaaaaattcgacatgttagagcctggtttatcttctttcgataccgattccgttggtgccgctaactcccttgacccattactgaaagtagcaatgaactatgtccctattaaggcaagaagttgtactcccgtggcggtgaaagctactgcaggcctaagactcttgggtgatgccaaatcttcaaaaattttgagcgctgtaagggatcatttggagaaggactatcctttcccagttgtcgaaggtgatggtgtttccatcatgggcggtgatgaagaaggtgtcttcgcctggattactacaaactacctattaggtaatatcggtgctaatggccccaagttacctactgctgccgtttttgacttaggcggagggtctacacaaattgtttttgagcctactttcccaataaatgaaaaaatggtcgatggtgagcataaatttgatttgaagtttggtgatgaaaattacaccttgtaccaattttctcatctaggttacggcttgaaggaaggaagaaataaagttaactctgttcttgtggaaaatgcattaaaagacggcaaaatattgaagggtgataacactaagactcatcaattgtcatctccatgcctaccgcctaaagttaatgccacaaatgaaaaggttacattagaatccaaggaaacttataccattgactttatagggccggacgagccaagtggtgcacaatgtagatttctgactgatgaaattttgaataaagatgctcagtgccagtctccaccatgctctttcaatggggttcaccaaccttctttagttcgtacattcaaagaatcgaacgatatctatattttctcttatttctacgacagaacccgtccattgggtatgcccttgtcctttactttgaatgaattgaacgatttggcaagaatagtgtgtaaaggcgaagaaacttggaatagtgtcttcagtggcattgcggggtccctagatgaattggaaagtgactcgcacttctgtttggacttatcttttcaagtgtccttattacatacgggatatgacattccattacaaagagaattgaggactggaaagaaaattgccaataaagaaatcggttggtgtttaggtgcgtcattaccattgttgaaagctgataactggaaatgtaaaattcaatcagcttgaataagaacatggacaccgcttttcgtcccatgtatattaaggaagaggagattgcggtgatatgtattctgttatatgtcctattctataacccttgaacaatatgtaaacgatttttacgttatgaaaatcactattatccccacaatagtttattataacaccgccgccaagacaggggattgaaacggccttccgaggtttatccattcttggtaaaagcccgccacgccttcaggtgtttgagtatgaactggaagaattatttgttaggaccgcataatcttgaacatatgagataatttaatatacttttgttatggattgttccgttgttttaagactatatggctttgttttagttttagggtgattgtggatatcacaccggtcctcaagaaaagcgaaaacaaaagggtaatcggacttatctggtgatcgaagaaactgcatttcaggtcgtttaataaactgctagctattgatattatatatataaataaacctacaatcaggttagtgtattcatctcccttctatagcgttgtgaaagggaaatggaaatagtgcaatctcaataaatctgcttacgtgacattttttactaaaagagaatatgaaaactgatagattactgattaacgcttccccggagacatgtaccaagggagatgctgagatggatactatggatactattggcagaatgacatcagttaaagttttagcggaaggcaaggtattaagcaatttcgaagaaccgggcttaatgaggtgcgcttatcatgatgcaaaaaactgggtcagaagattatcgagcgaaacaattgtcggtgaggacacgagtaatttatacccattttatgttgatactgcatacgatgtaaggcgtttgagaaaggatattataaatgctaaggttgacttgcaggttgaaaacctgatcataatctgcaatattaatgatatttccactgtatttctcatgagagaagtggtggaatggatcttacgcaatttccattcaatgactgtatatgtacaagatatttttgaaaagtcaactcagtttgctgttggtgacctctgcaaagacagcaattgcagtaaaaacagagtaaagtattggtcaaaagaatttgttgaaaaacacgattcattctttgacttgatgattacactagggggtgatggaactgtcctttttgcttcatctatattcacgaaagatgttccgccgattgttccatttgcccttggatcattaggatttctaacaaattttgaatttcaaaatttcaaagaaacattgaaacatatcttaacagatgaggttcgtattaatttacgaatgaggttgcaatgcaaactctaccgtagaaataaaccagaaattgatgccgcaactgggagaaaaatatgttacatcgatttcatctccgaacatcacgtattgaacgaagtaaccatagatagaggtccagctccttgtttatccctattagaactctatggaaacgactcactaatgactaaggttcagggagatggattgattgttgccacgcctacgggatccacggcatactcattgagtgcaggaggctctttaatatcgccaagcgtaaatgccatagcggtgacgcctatatgtcctcatactttgagctttaggcctataattttaccagatagcatggaattaaaagttagagtagatatgaactcaagagggacgtcgtgggtgaattttgacggaaaagatagagttgaattgaaacagggtgactatgttgtgataactgcaagcccctattcggtaccgactatcgagtcatctgccagtgaattttttgaaagtatcagtaaaaatcttaattggaatgaccgcgaagagcagaagccatttgcacatattctctcgccaaaaaatcaagaaaaatatagattagactcatcgaaaaatggaaacgacaccataagtaatcccctcgagagttcatgcataagctcagatgcacaagatgaggagaggaaatccgtaacggaaacagaaacagaaatagttgttgaacggactcgtcaggctcattttgcaatctaacgatttcccacatcctgcgtttccgtaatcaagggttcataatggatgatgagcctgtaaacagctttgtatttacctcttttacttcaagaatgctcttgcgtcgtttgcagtgtcgaagaagattcagtagagctatacaaaatggagaaatgaaacagttgaaccagagcgccgcatttggcaggtagtttcgctaaatttcctcatgcgcgtttgtaattatgctagttaaccatatgataaggttgcctaacttgcagtcaccggaaggttatttccggaatggtgcagaataatttttaaaatagtagcatatatttcgttccaattcccaaatagggaattataattatgacagataaattcccgattaggaagaagcgcgaaaattcttgaaaaacttttttcaacctcgaagaaaatcgtcgtccttcgaagatttagtgggaatcttcaaggtggatagtttccaaattaaaactgtagaagaggcttttaaaacatgcctgaggtataaaaagaacaacattcctggtgattatggtttctgttggaccctgttccctttgtaaaacttctatttattgtcctgcaaataagctaattatataattaataatggcaatcgttaatagttggctaatttgtttagtcagtattttttccttcgtggtacgtgtagaggccgctacattttgcaatgcaactcaagcatgtcccgaagataaaccatgttgctcacaatatggtgaatgtggtactggtcaatattgtctgaacaactgtgatgtaagatattcgtttagtcatgattcatgtatgcctgtacctatctgcaagagttcatccactaaattcaaagattattcctctaagttggggaatgctaacactttcttaggaaatgttagtgaggctgattggttgtatactggtgacgttttggattatgatgatgaagaaagtttaattttggcgatgcccaagaacagtggtggtaccgttctttcctccacgagggctgtttggtatggtaaggtcagtgctagaataaagacgtcacatcttgctggtgtggtcactgggttcattctgtattccggcgcaggtgatgaacttgattacgaattcgtcggtgctgatctagaaactgctcaaacgaatttctattgggaaagtgttttgaactacacgaattctgccaatatttccactactgatacatttgaaaactaccatacttacgaattagattggcacgaagattatgtaacatggtccatcgatggtgtcgtcggtagaaccttgtacaagaacgaaacttataacgccaccacccaaaaatatcaatatccacaaaccccatccaaggtggatatttccatttggccaggtggtaattctaccaacgctccaggaaccattgcatggtctggtggtgaaattaattgggacgcagcggatatcagcaacccaggatattattatgctattgtcaatgaagttaatatcacatgttatgatccaccaagcgataccaagaagaatggtacttctgcttatgtgtatacttcgtccagtgaatttttggccaaagacattgctattaccgatgatgaggtcacgatggacagtgatgagggatctggcttggacccacataagggagctaccacatcttccacccaaaagagttcttcctcaactgcaacctcttcctccaaaacgtcatccgatcacagcagttcaactaagaagagtagtaagactagttccaccgcttcatcatcatcatcttcttcttcttcttcttcttcttcctctactgctactaagaacggagataaggtcgtatcctccgtatcctcttctgtcacttcccaaactcaaacaacatcttctgtaagcggaagcgcctccagcagtacaagctcaatgagcggtaataacgcaggtgctaacgtagcggcaaactggcatttgactgttttatgtgtcatcctaggttatgtcttataggaggatctgcatctaagaacaaataggctacacaggactctcaaaaaaaaaagtattaataaataaaagaacttaaatatagactttctatttgcatgcatataaaaataattaattaataaataactgtaaaaaactagaataataaaaataataaatatctcgtccggcgacatagcctatttggcagcttttgtcatataagtaattaaatcgtttctgtccttttccttcttcaacccggcaaacgccatcttggtaccaggaatatatttctttgggttcgtcaagtactcggacatactatcctcatcccatttgacgttcttgttgatgtttgcatctgtgtaagaataaccctttacctgacctgaatgtctaccaaaaataccatgtaaattaggtccaactttgttaggaccaccctcttctattgtatgacactgctgacacctcgttttaaacaatgtagcacccttttttgcagagcctggtttgaatcccgtactttctttagccatgttttgtttatgatgtaatgtagtttactgaagtttacttaaagtaatgtgaataaatgcttgtatgtgatcttcttgtataagtctttgattttgtttcaactttaacaaaaagagagctattctgatctaatcttctcgagcttcacaccacgatatatatatatatgttgtgtgcctttgtctttgccccttgcggccacttacagtagttggaacttgaataaatgccctcgctattatcgctattagctttgagaaggtgggaaaagacccctcggcgggggactgcagacccttctcagagaaggcacgaaggaaaataatacaataaggggcgctataacccggctgctgatccatttcttttttcgtttctttttcttcaagcggaatgataataataataccaacgatgacggtggtgagtgggatgaataaggaatggtcattgggcaaaacgtcctgctagctcgtataccaaaaatgggagacaattactcgacttatttgcttgatattgaagggacagtatgcccgatctcgttcgtgaaggagactttatccccttatttcacgaagaaagtgccgcaattggttcaacaggatacaagggactccccggtttccaacattctgtcgcagtttcacatcgacgataaggagcagttgcaggcgcatattttggagttggtagccaaggatgtgaaggatccaatcttgaaacagttgcaaggctacatctgggctcagggatacgagtctgggcagattaaggcgcccgtttatgcagatgctattgactttatcaagaggaagaagcgtgtgtttatctactctagtggatctgtaaaggcacagaaattgctgttcgggtatgttcaggatcccaacgcgcctgcgcatgattcgttggatttgaattcttatatagatggttatttcgacatcaacacttctggaaagaaaaccgaaacacagtcttacgccaacatcttgcgggatatcggtgcgaaggctagcgaggtactgttcttgagcgataatccattggaattggacgcagcggccggtgttggaatagctactgggttagcttcccgacctggtaatgcacctgtccccgatgggcaaaagtaccaggtatacaaggattttgaaactctttaacaaaactgtatatatgcgctaaaagcagtataatcgttatttgttgttgttattattattattattattgagattaatattaccatctctctgttttcttttctttcccttctagcatatataaatacacatacgttattgatttctacgtaagcttttttttacccttggctcaaaaatcatgcagcattgtcgagaataagtgaagatacttcaagccataacattactgcaatctcagtcggcatgatcgctgaatagaatatttgctgcagcttcttcgtttttatcgcacgcaaaatacacctggataacaagatctctttcaaagcccaattcacagaggcgcgaaatagcttgatcgtcttcgggggtatagtcaacttggaaagaaccttcaccttcaccttgtcccagtcctgcagcagcagcctctcctgtaacttctatatcctctccttccaccatatcatccgcaccttccataacatcttgcatattgtcacccacggcttctagcaacatggacacaaacacttctggatttgccatgatatgttcacgtaattgaggatatctagcacttatgttttccaacaatggggctaaagcttctgggttacctgaaacgacctgtctcaacgatagtaaatcttctacagtgaggccaatggaacctggaggtccaccttgcgcagcatctgtagctcctccagttgtgccaagcgcaccggatgaagcattaccgccttgggcagcttgtgcaaataagtcgtcttcagccggttgttccgcagtggtggcggctgtcgatggttgttccgctgcggcggctgtttgttgctgtggttccggttgacgcagattttctggaatacccatcagtagatattccaccgctctatctggattattaaaggctgctctcaaggctcgttcgacttcctctctttggtagcccatttccatgattctctcgatggtctcgttcctctcggttcccaccacgaatcccggtgtagaggcagattcagtacgttctgtagtggcggtttgttcttcttgcggttgtgagccttcgggagcagtggcagcaggagctgcagaagcatccgtactgggggatgcttctgtagaattttctcttccgggggtagtggcgctctcaggagcaattggaggttctgttactttggtcttcgtggactttttttgagaaaccatgaagacaacttggtccccatcttttagcccgcattccgatacggttttggaatcttgtagcactttacccgagtagatcagttttatttgagattcttcacaagaaatggattgagcaagcttggtcttggtctctaaaattgtgtttgaaggttccagatctaaaggaactttttccttcttgaaatttttaaaggttaagctaaccatttttctattgtatgttgtctttgtgtgatctgtgattaaaaggtggagttagatgcctttattaaatctttagaggaaggaaaattggatggtagcaagcttgtctgcgaacggccttatcaatggttcaaacttaaaaacagggagaaaaacctaagtgtaccttctagctttagctgctagtcaatactggatgggaccttgttctatcattttttcttaagttttgctgtcgctatttcttgcctagccataatgaaagagaagaaaagaaaaaaatttcaatttcgccaccgagccgtgtatagtgattgatatatcaatagtattgtaattcactcaaagaaaagttaaagaccaaagaatggaggtttgatattattatcggtatatatgtacaactatatgaattcgtacttcatatgtaggtcactaaaaaaccgagcctagtttctatcagggtcgaagtctaatggaacttctttaggatgttttttcttgttcttgtcgttgtcatcaagaggtttcccctgcaggttgccgtcgagctgttgttgctgttgttgttgctgctgctgctgttgttgttgttgttgctgttgttgttgttggttgtttggtgagacaaagtcaccctttgagtccaccagctccgagccatctccctcttcagaccagtctacagtgactttattgttcaaagtggagtcaatgttttttaatattgaatctctttcttcgttccattggtctctgacatcttcaaatccaatctcccagatcttgttgtaaaattcgcgaattctctcttcttctagtttccgcttctcctcttcagccatccaagccatgtgctttaagtcgtcactggaaggttcgtagatgtgccagatgacataatggggcaagccgatgacattgtaattcatcctgcgggagagtctaccgaatgcttctgtctctgcgtgcttttcaaaggagaatgcaggaaagtgtgagcctgttctgaacactttagctttcgcgagaatcgagacccctccaataccgtccaattccatttcgtcttctggattaccgtttggatctctcatgtatgccaggtgaggtctccaagtggcgtactctgggtacccttccacaatgacagcatcttcgtctagggaatccgccaattgaagacccccttctgattccttccatgaatttaaatcgtagggttgaatgtttcccagccagtctggtaaaggtctccagacgttggggacaatgacgtccttgtcgtgatgcattagatcctccatgatggtagtggggatggtttcgacatccacgtctctccagtaaacccaggagtggtatggtttcagggccacggacccaagccaattacgagccctggccatcagctttcttctggggccctgggcgccaaacccgtgacgatcagaaaaggactgaccaatgatttggccgaagtccttctcatagatttcgatgttaccaaaccttttggacttgtcttgttgcgattgcgccatctgtagattggatagtaacacgcccatggtgttatccgaagagtcactcaccaaaaacgacagatcaatcaggttgtgcggatatgtcatggtattcagatggttaaaaaacatgggaagatgctcagaagcatctctcagtggcacgcaaaacaagatgcggtcaccctgttgccaaccatctttgttgccttggtaatttcgtaggtcgtagaactctacgctgggagtatttttaaaatctggaacatagggcttgaagattccttggaaagttaccagctggaatagcgatatcgagaagaacgaaagcacgagtcttgtgagaaagaacaccgtaagcaacgttccagcgatacttactgtggtagggttgaacgagagttttctgttattatacttcattatggacgtacactttgcatgaaagccacaaggaactgtttaatggagcgaaaaaaagatgatgagggtaaatcgcaccaacactcgcctagcaactgagtgatgaatggttttgcaatgcttgctgtctctactaacagatcttggcgtttttgaatcgtgtagttatttttatttattttttttatttcatgttttcatgatttcatcttacgcaattttttcacgatgagacaaggcgggcgaccccacacaagaggaaaattgaacacaatgcgttggtaaagggattacgaattgattaaaccaacatagtgagacaagaaaagaaaagaaaagaaaaggaaaatagaaaaaaaataaaaaaagaaaggcaactagaccagatgagcccggttcatttctattctctgcagtcactgctattttcatcaacagcgcaggccaagttgaacgagatagtagcaatcgtaaaaggaactagctaacttcatcatgaaagtttaccctttcttgccgctacccttctcgtttggctggtattagagcacagcggatatatccggctcaacagtataagtaacgataagtcctgaccattggcttcgttctggtggcattttctctgaggggtgagaacagcaaaacgggaacggcgacttggagtagtataacgctgtagctggacgctgaggggccaaggccggtaaaattctgcaacacccagaccttgctgcagtgatatcatccacccatacccctcgatgtattccgtagcgttatatcgggtccgtgtgaggcgacaagggacctcccgcaccgcacataccgcaggagctaaaagaaacgccgtcgcccgaaaaaaagtttcgaaggtgaaggaacagtggtaataaaaatttttttcgtcgtcgtcgtcgatcggcttttggccgcgttgatcgtcgtgttccacgattatataatgcacaaggtttttgccatatcttgacattggaatccctcatttcctaaattcctctccttctatcaattgcttcctttccttctttctaacgattctacttctgtagccaattactcatagactcccaaacacacacaaataccaactcatatatacaatgtctgacgaagaacacacctttgaaactgctgacgctggttcctccgccacctacccaatgcaatgttctgccttgagaaagaacggtttcgttgtcatcaagagtagaccatgtaagattgtcgacatgtccacttctaagactggtaagcacggtcacgctaaagtccatttggttgccattgatatcttcactggtaagaagttggaagatttgtctccatctactcacaacatggaagttccagttgtcaagagaaacgaataccaattgttggacattgatgacggtttcttgtctttgatgaacatggacggtgacactaaggatgatgtcaaggctccagaaggtgaattgggtgacagtttgcaaactgcttttgatgaaggtaaggacttgatggttaccatcatctccgctatgggtgaagaagccgccatctccttcaaggaagctgctagaaccgattaaaccggttaacatcatggcatgggatataaatgaaaaaagaaaaaaaaactccgacgccccttccatcacatcatgtactcttcgctgaaccgggtttttttctttgcaatttttttttcgttctcctaaagcatacacaaataaatccttttttttattttctatttattttgttatttatcatctatatagcaataatatactttgtttttattcgtatttcacacttttctttttccttatgcaggcagtgtaattcattggggaggatgattttcatgtgcgcatatctaccggctgcaagcagccggtcggtggcaaatccggcgcttcccccctaaaaaaaaaaaaaaaaaaaaaaaggcgtctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttttctcttttttttcaatttcccttgttcgtcagatcgaggcggtagaagaaacaattacttttcctaaatgggtaaaaactcgtgttttaggaaaaaaaagaaaaatttggtcaaaactcgaaagataggttcttaatcttctttcaagttgaaaaggcctacgctcttttccttgaagcattttcatcctactgctcgtattgaactccactataagcgcaccaaaaagatacaaacgtcaattatggaaggctcaacgggatttgatggagacgctactacttttttcgctccagacgctgtgtttggtgacagagtgcgcagatttcaagagtttttagatactttcacctcatacagagactctgtaaggtccatacaagtttacaacagcaataacgcggccaactacaacgatgatcaagatgacgcagacgaacgagatttgctaggtgatgacgacggtgatgatcttgaaaaggaaaagaaagcagcatcgtccacctcattgaatatactccctcacaggattatcatctcgcttgatgacttgagagaattcgacaggtcgttctggtcgggcattttagtcgaaccagcatacttcatcccgcctgccgaaaaggcgctcactgacctagcagattccatggacgatgttccacatcccaatgcctctgcagtatcgtctcgccatccttggaagctttcgttcaaaggctcatttggtgcacacgcattgtctcctcgtactctaacggcacaacatttaaacaaactggtctctgttgagggtatcgtaactaagacttcgttggtcaggccaaagcttatcagatctgtccactacgcggcaaagaccggtagattccattacagagattatacagatgctactacaactctcaccacccgcatcccaacgcctgccatctatccaacggaggacactgaaggtaacaaactaaccaccgaatatgggtatagtacgttcatagaccatcagcgtatcactgtgcaagaaatgcccgaaatggcccccgctggccaacttcccaggtccattgacgtcattctcgatgacgaccttgtggacaagaccaagccaggtgacagagttaacgttgtcggggtattcaagtcgcttggtgctggtggcatgaaccagtccaactctaatacattgatcgggttcaaaactctgatcctaggtaatacggtgtatcctctccacgccagatccacgggtgtcgctgcgagacaaatgttgacagatttcgatataagaaatatcaataaactatccaaaaaaaaggacattttcgatatcttgtctcaatctttagcgccttctatttatggacatgaccatataaagaaagccattttattgatgctcatgggaggtgtggagaaaaatttagaaaatggctcgcatttaagaggtgacatcaatatcctaatggtgggtgatccatccactgccaagtcccaattgctaaggtttgtgttgaatacagcatcactggcaattgctactactggtagaggttcttccggtgtcggtttgaccgcagcggtcactactgatagggaaacaggtgaaagaagactagaggctggtgccatggttcttgctgaccgcggggttgtatgtattgatgaatttgataagatgacagatgtggatagagtcgccattcatgaagtaatggaacaacaaacggtgacgattgccaaagcaggtattcacacaacattaaatgctcgttgtagtgttattgctgccgcaaatcccgtttttgggcagtacgatgtcaatagagatccacaccaaaacattgccctaccggactcgctgttgtctcgttttgatttactatttgttgtgacagacgatatcaatgaaatcagagatagatccattagtgagcatgtcttaagaacacacagatatttgcctccaggttatttagagggtgaacctgtgagagagcgtttgaatttatcattagccgttggggaggatgcagatataaatcctgaagagcattccaactccggggctggtgtagaaaatgaaggagaagatgatgaagaccatgtcttcgaaaagttcaaccccttattacaagcaggtgctaagttagcaaaaaacaaaggtaactataacggtacagaaattccaaagctagtcaccatcccattcttaagaaagtacgttcaatatgccaaggaaagggttattccacagttaacacaagaagccatcaatgttattgtgaaaaattatactgatttaagaaacgatgataataccaaaaaatctcccattactgcaagaactttggagacattgatcagattagccacagctcacgccaaagtcaggttatccaaaacagtcaacaaggtggatgctaaagtggctgccaatctactaaggtttgcactattgggtgaggatatcggcaatgatatcgatgaagaggaaagtgaatacgaagaagctttgtcgaagaggtctccacagaaatcaccgaaaaaaagacaaagagtcagacaaccagcaagcaactctggatccccaatcaaatctactccaagaaggtcaacggcatcttccgttaatgccacgccatcgtcagcacgcagaatattacgttttcaagatgacgaacagaacgctggtgaagacgataacgatataatgtcaccgcttcctgcggatgaggaagctgaattacaaagaaggcttcaactggggttgagagtgtctccaagacgtagagaacatcttcacgcacctgaggaaggttcgtcgggacctcttaccgaggtcggtactccaagattacctaacgtatcttctgcaggtcaggatgatgagcaacaacagtcagttatttcttttgacaatgtggagcctggtaccatttctactggtagattgtctttaatctcaggtattattgcgcgtctgatgcaaacagaaatatttgaagaagaatcctatcctgtggcctctttgttcgaaagaatcaacgaagaactaccggaggaggaaaaattctccgctcaagaatatttagcaggtttgaagatcatgtcggacagaaataacttaatggttgctgacgataaagtttggagagtctgatgtcacaggaatgtttactaaaagacttccattcttggctttttttctttttgtcattcataattttcagttcatttccagattatttagttcattaattgttattcgtgtattaaagaattatgtattaaaacgcttatttccttcttttgtttgaatgtgttgtaagcagttatggggcactatatcttctgttaatgaatatgtgtgatactttggcttatcttacttgctcattcgtggcttcttgtcacgccatacgttacgcgtttctcttcctcttcgcgtgttctgaataaagccaagtggcaatgtctcttccaccatataacatgaagctttagcaagcttttagctctagacatagttgacatatcagacctacagaaacataggaatcggtaaatgacaaagaaatcatttgtgagcagtcctattgttagggactcgacattgctggtaccaaagtcattaatagcaaagccgtacgtattaccgtttttcccgttatacgctacctttgcccaactatatttccagcaatatgatcgttacatcaaaggacctgagtggacttttgtctacttggggacattggtatccttgaacatcctagtcatgttaatgcctgcttggaatgtcaagatcaaggcgaaattcaactacagtactactaaaaatgtcaatgaagctactcacattctcatctacaccactccaaataatggttctgatggtatcgttgaaattcagagagtaactgaagcgggctctttgcagacttttttccaatttcaaaagaaaagattcttgtggcatgaaaatgagcaggtattttcttcaccaaagttccttgttgatgaatcttcaaagatcggtgatttccaaaaatgtaagggccattccggtgacctaactcatttgaagagactatatggtgagaatagttttgatattcctattccaacatttatggagttattcaaagagcacgctgttgcgccattgtttgttttccaagttttctgtgttgccttatggctattggatgagttctggtattattctttgtttaacttattcatgattatctccatggaggcagctgcagtatttcaaagattaactgccttgaaggaatttagaactatgggtatcaaaccttataccattaacgtgtttagaaacaaaaaatgggtagcattgcaaaccaatgaattgttacctatggatttagtgtctataacaagaaccgccgaggagagcgcaattccttgcgatttgatcttgctcgatggctccgctattgttaatgaagcaatgctttcaggtgaatctactcccttgttaaaggaatccattaaattacgtcctagtgaagataatttacaactggacggtgttgacaagattgctgtgttacatggtggtacaaaggcattacaagtaacacctcctgaacataaatcagatatccctcctccacctgatggaggtgccttagccatcgtcaccaaaactggctttgaaacatctcagggttctttagttcgagttatgatttactccgctgaacgtgtttccgtcgataataaggaagcgttgatgttcattcttttcttgttgattttcgctgttattgcttcctggtacgtttgggttgagggtacaaaaatgggtagaattcaatccaaattgatcttggactgtatattaattattacatctgttgttcctcctgagttaccaatggaattgaccatggctgtcaacagttctctggctgcccttgccaagttctatgtctattgtactgaaccatttagaattccatttgctggtagaattgatgtttgttgttttgataaaactggtactttgaccggcgaagatcttgtatttgaaggtctagctggtatctctgcggactccgaaaacattcgtcacttgtacagtgctgccgaagcaccagaaagtacaattcttgtcattggtgctgctcacgctttagttaaattggaagatggtgatattgttggtgacccaatggaaaaggcgaccttaaaggctgttggttgggctgtcgaaagaaaaaacagtaactatagagagggcaccggaaaattggatattatccgtagatttcaattttcttctgctttaaaaaggtctgcttctattgcttctcacaacgatgccttgtttgctgctgtcaaaggtgcacctgaaacgattcgtgaaaggctttctgacattcccaagaattatgacgaaatctataaatcctttacacgctctggttcaagagttttggctttggcttctaagtcgttgccaaaaatgtctcagtctaaaattgatgatctaaaccgtgatgatgttgaatctgaattaacctttaatgggtttttgattttccattgtcctctgaaggatgacgctattgaaaccattaaaatgttaaatgaatcctcccatcgttctattatgattactggtgataatccattaactgctgttcatgtggctaaagaagttggcatagtttttggcgaaactttaatcttagacagagcaggtaaatctgacgacaatcagttgctgttccgtgatgttgaagagacagtttccatcccatttgatccatcaaaagacacttttgatcattctaaattatttgatagatatgatattgctgttactggatatgctttgaatgccttggaagggcattctcaattaagggatctattacgtcacacctgggtttacgcacgtgtttcaccatcccaaaaggagttcttgctgaatacactaaaggatatgggatatcaaactttaatgtgcggtgatggtactaatgatgttggtgctttgaaacaagctcatgttggtattgcattgttgaatggtaccgaagaaggtttgaaaaaattgggtgaacaacgcagattggaaggtatgaaaatgatgtatataaagcaaactgaatttatggctagatggaatcaaccacagccacctgttcctgaaccgattgcacacttattcccacctggtccaaaaaatcctcattatctgaaagctttagaaagcaaaggtaccgtcattacgccagaaatcagaaaagcagttgaagaagcaaattccaaacctgttgaagtcatcaaaccaaatggactatcggaaaaaaaacctgctgacttagcttctttgttgttgaactctgctggtgatgcccaaggtgatgaagcaccagctctaaagttaggagatgcatcttgcgctgccccttttacctcgaaactggccaatgtttctgctgttactaacattatacgtcaaggccgttgtgctttagttaacacaattcaaatgtacaaaatcttggccttgaattgtttaatcagtgcctactctttgtccatcatttacatggctggtgtcaaatttggtgatggtcaagccactgtctccggtttgttactatcggtttgtttcttgagtatttcccgtggtaaacctttagaaaaactatccaagcaaaggccacagtccggaattttcaatgtttacattatgggatctattttgtctcaatttgccgttcatattgccactttagtttacatcactacagagatttataaattggaacccagagagccacaagttgatcttgaaaaggaatttgctccatcattattgaatacgggtattttcatcattcagttggtacaacaagtctctacatttgctgtcaattatcaaggtgagccattcagagaaaacattaggagtaacaaaggtatgtattatggtttattgggtgtgacaggtttggcacttgcaagtgctactgaatttttacctgagctaaacgaagccatgaagtttgtgccaatgactgatgactttaagattaagttgaccctaacattattgctcgatttctttggtagttggggtgtcgagcattttttcaagtttttcttcatggacgacaaaccatcagacatttctgtgcaacaggtcaagattgcctctaaatgataaatcttttatgtagtacccctttttgtatttatatacttatattacccattcatatagatcttttttaatgggtgtattgttaagtttatgaaagtgctgtattatttgtaaaacagcttctaagtatacgaaaattataatagcttcaagtttatattttgttgctagcgttacggttatgtttttacgatacatatcgcctaagcaggtctctgcgcctaaaaaaagtaaacatataaattgggaaagcaatataattaaacatactgctatagtaaattcattactaggccaatttaaccgtgccttattatgatatgaaataccagtcaacaagtcccgcttaaatgcactctagtaaagctacaggtggttaacaaaaattaagaaaacagaacaaccacgagattctttgaacacggtctgtcaaagatcttgacttggactagttacacaatttattttccaactgagtggtttagcacaggaatagtttaatcgggtcttaaatttttactttgatttttgcaggggagatgctaagtcaaattgcagcaccctttaaagggtcagacgtagaacatcaaaaaaagaacaaatctcaaaaatgattatttaactaagattagcaaacttcaaaatcatggcgattaattgataccctattgatttttttaccgaagagcatttgtaactatttcactggtcataattaagaacttaaattcaagtaacatgttaccatcatggaaagcctttaaagcacataatatacttcgtattctgacccgtttccagtcaaccaaaattccagatgcagttatcggtattgatttaggtactaccaattctgcggtagctattatggaaggtaaagttccgagaattatcgaaaatgcagaaggctcaagaactactccgtctgtagtggctttcactaaagacggagaacgtttagttggtgagccagccaaacgacaatccgtcataaactcagaaaacactttgtttgctactaagcgtttaatcggccgccgtttcgaggacgctgaagtccaaagagatattaatcaggttcctttcaaaatcgtcaagcattctaatggagatgcctgggtagaggctagaaacagaacgtactcccccgcccaaataggaggttttatcttaaataaaatgaaggaaacagcggaggcttacttagcgaagagcgtcaaaaatgctgttgtcaccgttcctgcttacttcaatgatgcccaaagacaagctactaaagacgcaggacaaattattgggcttaatgtattacgtgttgtcaacgaaccaacagctgctgccctagcttacggtctagataaatcagagccaaaagtcattgctgttttcgacttgggcggtggtactttcgatatttcaatcctggacatcgataacggtatctttgaggttaaatctaccaatggtgacacccatttgggtggcgaagattttgacatttatttgttgcaagaaattatttctcatttcaagaaagaaaccggtatcgatttgagtaatgaccgtatggctgtccaaagaataagagaagccgctgaaaaggctaaaatcgaactgtcttctacactctctacagaaataaacttgcctttcataactgctgatgctgcaggcccaaagcatattcgtatgcccttttctagggttcagcttgagaatataaccgccccattgattgatagaacggttgatcctgtcaaaaaagcactgaaagacgcaagaattaccgcctcagatatatcggatgttttattagttggtggtatgtcaaggatgcccaaggttgcagatactgtaaagaaattattcggtaaggatgcatcaaaagctgttaaccctgatgaagcagtcgctttaggggccgctatacaggctgcggtcttgtctggtgaagttaccgatgttttgttgctagatgtcactcccctatcattgggtattgaaactttaggaggagtttttacaaaattaatcccaagaaattctacaattcccaataagaaatctcaaattttttcaactgcggcatcaggtcaaacatcggtggaagttaaagttttccaaggtgagagggagttagtcaaggataacaaattaataggtaattttactcttgcgggcattcctccagctccaaaaggtatcccacaaattgaagtcacttttgatatcgatgcgaacggcatcatcaacgtttcagcaaaagatctcgccagccacaaagactcttccatcactgttgccggagcgtctgggctatctgatacggagattgatcgaatggttaatgaagcggaaagatataaaaatcaggatagagccagaaggaatgccatcgaaaccgctaacaaagctgaccagctagctaatgacacagaaaattccattaaggaattcgaaggtaagctagataaaactgattctcaaagactaaaagatcaaatttcatccttaagggaattggtttctcggattcaagctggagatgaggttaatgatgacgatgttggaacaaaaattgacaatttgcgaacttcatcgatgaaactttttgaacagttatacaagaacagtgacaatcctgaaactaagaacgggagagaaaataaataacacaagataataaaaaagataatattttcgtttaaaatttcagaaatattgcttacatcaaacgaaatagtaagcgtaaaccatatatcctttcaacgatatgtatcatttttatagtcttttggcggtataaaaagaatagccaaaggtggaagtcaggttaaaccaaaagaaactacccgcaagggatgtatgcatttgaacataaaaaactattcactattttacaaatgtcaacattaattttctttggtgaaaatatgactctataaagtttcatcacaaccttgcgtaaatataatctgtttgatgaatgttgattgtttcatatatatctcttgattcaataagacgcaattccatttctttcatttccaaggcggaacccatttttgctttcatttttcctgaagcatagctcctagtaattttcaaaaccttctgaataacattaagaacattattgacttggtcttcaaattttaatgttgttgtagggttcgataagatcttatacactcgatccaataacaaagcagaaaacaaatcaccaaccccagtgaaatacgaatcaataaacggcactctgtaaacaatgggggttttaccctccattgaagctacgcaataaataaaatctttgtcatcaaacatcttacagtcacaggatgtgacaatgatcactgggatagtttggtgtaatttctttaaggccttcttcaaatgttctttagtcttgatttcccccccataaagtatctccagctcaaattgattcggagttattatatcgactagctgttttggagacaaagccagctttctatattctggtataacatcctcactaacatataattgtccttcgtcacccataacaggatccataagccatatcatttctggattcgcctctttaaatttagcgtagtatgttcccatacatcgaacggaattcttattgggcaagtagcctgaaagtaaggcttggtagtcttgggaaaaattatcaaaaagacctgataagagttccttcaaatctgtttccctagttatagtcccaaacactttatctaaaccatatccggtatggttggaaaactgaacactgttacagcaatccacatcccagcctagacactgtaagggaaacgttgcagccttatttcccacatatccatgtacaacatgagactgcgtggccaagagacgaggcattttttcgtaatttttcgatagctactgcagaccaaactcagggagatttagtagtcagtgaactcaaattcttttcaacttttaaatctacgcaaactaataaattttcggtcgatagtaaagcagtcatgattacatctcttgcttatttttgaaatatttcagtcatcggacaatggcggaaatagaattcacatatttccgcctttgatgcaagaaaaggctaaaaggctcatgaacttagctgttacaatgttaaattagctaaaaggcagccatcgccatgtcggaggaaaaaaaaccgtaacaataaattaggtttggacttttgcagtatttaatgagagttggtggccaagaataatggatgatagcgcatcaaaaaaaggaagctgatatgaacgacttcacatagaactttgactcttctacaacgtgaatgcctttgataagaatgaaattccaaaacaagtagtgttgggaggtaaatttcctccactgctaattccaactacgtgtgcatttttcaatagtaatattccgtcacaagaggcttattttcattttctctaccctcatctttttttcacttttttccttacaatgaatacatgtgatatagatacttaattgtctgttttgcgagcttgcttcttcatatctatgtaatatgggccaggtcaacccaacatctaccaattatctatatgatgaaaaatatgattggtagttaccgccaatgcatagattttagacaacttaataaggccatgttaaagggtgcattcccactatcgcgcttaggattggatgaagcataacttttcttcactgtcaaattgcatcgtagttatatcagatccaaataaaaaatgaaaataacaataacaagccttctattttttcttgtcatgatcgtcgagctcgcaagtgcgggcacactacttcataatggtgcaaatttgccctcattacgtgataacaccactctaactgatgctcgtaatgtgttaaagtacttacaagtgcttggttttccaagcaacaaaatagcggctacagatactgttggaacttttatcatatttagcaatcgtacggaagctaacactaccgctatgacgaagacagtgtcatactgttatcgtaactacgggcatagtttctacttcactcattacaaatacgactattttcctagtgggattagttatatggcaaaacttggcgatgccaccgtcaaccatacggacttacctcactttaggaacaacaaacggctaacaacgcaagaactcaatgccttccaacatccaattgtcgagtttcagtaagtactcaggtattacgttatgtacatgtatgataattctgattaacatcttttatacacaaagatgtatgcatgaatggtgcaaatatctcgacgatgcgcagtaaagaaagcaatttactactaacgtctagcgatatcatagatgatgacaggataacgatataggttagatggatattggagtaattgtcaagtcccattttgattgaagacaacattattaggcctacagagttgctaaaattctccactaggtcacaggagttcgcaaaagagaatcaacaatctacataaccatgcacacatttcttcgtcctctacgtcataatttactgctctaaaagcgtcacttctcctttcattttatgttttattgttcattatcctactacgttatcaatccttacatttcggcttccactaaatttaatgactgcttctcatcatttcatgtcatcttctaacgccgtatataataatatccctgcaaaatataactgttagttagtgaatcataaccgactgttactcctgcaatatccatgggagaaatcaccatcggaaggtaaactaacacgtaggtattgattctaccggaaatgaacaaatgtcgtactgcccaaatgagccaaatgccatcatatacgccttcataactatatttgaaaatacctttgcctaaaagacgagtggtattggaaacttcaattagtgttcaaaaatgtccagtgagaggatgaagttgtcgtggttgaaacagcataaaccacctaaaatagtatcaactgacaacaactgtggaacacatgcggttacttttataattaaccgcaaaatacctgaaatgagctaagaaatagtaattataaacatgccactacaagtaacagattaagtgatatgttggcggacctcaatataagcgacatggagagatagagataaaagaatttgttattgtgttaataaataaagttatcatccagttctttcaagttggctaagcgccgtggcgcagtggaagcgcgcagggctcataaccctgatgtcctcggatcgaaaccgagcggcgctaatttttcaattctttttgcccgcaacaataacacagatcgcaatcatttaagctatagactataagctttaacttctgcgttattattaataattgttacttgctttacttaggtatttctatcaacttattttatatattctatattgcagttttttttttctacaatttcacccagcaattatgtgttattaatagtacagcttctttaataatgaatttattattgcacaatattcaacttagggaagatagaggaactgaattctttatcagcaatgaaataggccgtctacggccgtctacggcctattccattgctaaaaatttgaatcgtataaagggatattacccggaaaagaaacgacaattaaaaaaaaaaaaaaaacagaaaagtggttaagtgattgactgacccttgatagtgttgtacaattatacactcgttctgattaaaaacttgtttataaaattctttttaaaagaaagagaagatcgtgtttattgcttttctcaaaaagactaatcaattagaataacaaaagaaacatatacatataatgactgaattgtgtcctgtctacgcccctttctttggtgccattggttgtgcctctgcaattatcttcacctcattaggtgctgcttacggtactgctaagtctggtgttggtatctgtgccacttgtgtgttgagaccagacctattattcaagaacattgttcctgttattatggctggtatcattgccatttacggtttagttgtttccgttttggtttgttattcgttgggtcaaaagcaagctctgtacaccggtttcatccaattgggtgccggtctatcagtcggtttgagtggtctagctgctggtttcgctattggtattgtcggtgatgcaggtgttagaggttcctctcaacaaccaagattattcgtcggtatgattttgattttgatttttgctgaagttttgggtctatacggtttgattgttgctttgttgttgaactccagggctactcaagatgttgtctgttaaggcagcttctgaatcactaaagcaggaatagagtatacaaaagaatctttttgtgagaaactatgaaaactatcaaaatttttcatcttagagattgtttatagcccctattcctacttcatatccaaactacctcatttcaagcttcctttttattagtaccattattattgtttaaaagagtattacacgctaaatatgtatatcttaatttttaatgtgtataaaatagaaaatttgaatatcaaggagcaacaaagagcattatgcgttttaagctacacaatgggtacgatgagatcactatacctgtactcttaaaagaggcccaaccttatcaacttctattgttaaagtagacaattgtatcgtttctttttcttatcggtttaatccgggtaataaattcagcatatagaaaaatttttcatttctgttttctttttcttttcattttttcctttttctcagaaaatttttttttctaatgctggaatgagatgagttagaaaatttttcactttaaaactgattattctggttaatagtgcttattcctcttagtgtttaagtcctactttcaaatcttaatttaaatcatcattcgagcgagctttctataccaggaccatactgattattgcaaggaacttgaataaaccagatttcatactataaaaactatattaaaaatgtctgccccaaacccaaaggctttcccattagccgatgctgcattaacccaacaaatcttggatgtcgttcaacaagctgctaacttgagacaattgaagaaaggtgccaacgaagctaccaaaactttgaaccgtggtatctccgaattcatcattatggctgctgactgtgaacctattgaaatcctattgcatttaccattactatgtgaagacaagaatgttccatatgtctttgtcccatctagagttgctttgggtagagcttgtggtgtttctagaccagttattgctgcttctattaccaccaacgatgcttctgctatcaagacccaaatctacgctgtcaaggacaagattgaaactttattaatttaagtagattggattatatctatcaacatagtttttgtaccatctatatactataaaaaagttttttgctttccactagtgcagacgctaatagtgctgttttgttagtggtatgatatatgtcatatcttcattgaataacctactcgagtgcatctgtaaatgcacaaacatgtattatcaattgagctgtagtaatttaggcataacaaaaagttgcaagatctcatggcacctattcgttcgtaggagatttattgtcacctttttagttttacaggatcgaaaaaatctatggtcttgtatggtgaatgatctatatgtcttctctttgaatttctagctagctcatcaaagccgctttcatttattccagtctctttactcacggaatattgtttagtaacatttcgcatgcttttctcagaccttcgaaaagctcttttacattcgagcttgatctttttgtaatcatgcaacgttctcatccacagctcaccaatgaattccgatattatataaatttggccctcagtaccgcaaagtaaaaatagaggtatgacgccctccaacctttgactattgaaatttggacatatttgaaggttttgaaatccatctgggatggccgccagtgagattatcttattaggtaaccgaattttgaggtatggcataaccaacccgcccttatcaactgataatttagaatcttcgtatattgtcaaggtattatcaataccaatggtggcaacataagatctattggaatatttcaacgttgcacaagaaaggtctgataatcgacctaataggtagttcttatcactcgctaaacaatcgtttttaggttctcttagcttcttaggaattattttagtcgccacttgtgtaatgcttcccaaccgcttaaaacccaagtagggacattcagggtactctgatggatatactatggacgtcctaattggaaagcgggttctcaaaaaatctctcaagatctcaaattgaaccagataatcaccactcatataagctggaagacctatatggttaatcgatgaaagtgctgggaaggaataggcctctaaaatttccgcgccctcttttagcatgtttattttatatgctgctatgccactatcaccagaaaataaaaccaagttgcactcatagtatatgaacaccgagaatatacaatcttcgagataattcgcgtacaattgggtaatgttattgtttctaatttcaaacagccagaattttgtacgtttttcaccaactcctaagcatacaacaaacttattaccataaaagggtctctgtgataagtagattgagttttgttctggccacagtggcttcacaacggcatgtaaatacttttcatccgagaaactgaatgtggaaactgccttcattgaagcataattgaatagcatcaacttatactgcctactattgctatcgaccaaacacaccacggcctgattgaggttatttggaacagtatagagctctacgggaatgctagggaggtaaaagatatgattttctaattgaggttttaatgaagtcatctgcttagtgaaaccttcacggtaaaacgtgctaccaaactcaaagatgcttattcgagaatcataatctaaaacacaaagagagaacagtgctttaccgggtcgaattctcattcgtcttggaactaagcctaactgtatgcaaccataagacatgttttgaagatttaacaaaattatttccttatcgttgtaaaggaaaaccaaaggtaaggaaggaatcgtatccaacagttctaatttctgatcgtataacgaatgaatctctaaatccactctcaaaaaatttgattctgatttgtagactcttacgcagccagtgtatgatgatgcgatgacataaatcgagtcgtgtttatgctttttgcttagccaagatatttttatcaattgatcataggctatgaaagaatagtctggatgtgatgtagccactttcttttgattggcattccataccgaaaacacaccgtccaagtaaatgacaaaaaggtatttctcggcaccatctgagaaacagctcacaatactctctttagaattgagcccatggataaaaaattcttcttttttacgtagaaaaccagattttgcctcaagtatcgaaatcctgagcttggagttctgtacgggataacaaaacatggtggaagagttgtggttcgactgcaagaaatcgacctgcctaaattctccggtagaaccatccataccggctttcaaaacttttcccgtcctagaaacaaatagaccgtaatcataaggctcatccattaaaaatattccgttcttataaatcaacccacctgattcatatgcaaattcgtcaccaccattaagtgctaaatctgtaacccaaaaatcagttacattctctactagcgctttggaggaagtcactaacttgaacagggttttgtcatataccaaaattttcttttctaaaaatcctcttcttgagttaaaacttccacccaaaagcagtgaatcaatatctgtccccttgtttccaataacttgtgatgccaggtaaactttgtttgtataagcgggaccgcttttcaccttttctaattttgaacctcgatgatctttcgatataaaatttactccatttattcttgtcaccgctatatacttttcacgtgggagctgcaaaataacatcgcatagatcatgtttaggaggcttgaacactctttcttttgtccattgtagttctttcaggacgtggtctctatgtaacgacctagtgtgtatcttggcagtgtatttgttagcatacacgtcagaaattgtcaagagaatgactgatctttcatatatcacatcataagaatcttttagaaattggtagttttctacatttgggagacctttattattgaaaaaagccccgtttgtaagcccacttgcttttatatttattatttgagtgtagttagtagtcaacactacaatggtatggccgcaaactaccttcatataacaaaattcattatcacatatcggcaaaagattgtattggcggtactcgtttaaatcaaatttcctacttccatgctttccagcaagattgtattcctttaaaaacaggttttcactatagcaactcttaagtaggcaaagaaaataaacgtgtgatttacctgtgcatgtggcgtcgtcaagcaaatcctccctgctaataaaatcaaaggagataatttcttcgccatcggtggcataaaatctttcgactattccttctctgaagtcaaaggagtaaattgtcgtacataacgtatgcaaatcactatcatatgatatgtttttattgcaagtgtataaaacaccctcaaaggaagcatttaaccagctggaagttaataaagaaatagtatccagtttcggagccacattagagtcgtagataatttcaaatttgttattttcgcatttgaatcccttaatggaaccgtcgttaaacattagcaggtgacagaaggaagctgacatgaacatcggtacagttgcgtagttaacaacgaacggtccatctaaagcgaactcaaccttcgctttcaattcgttggacgttccggtatacaatccatagctaaaacataaaaagtaacttccttcgtgatgaagacaacttaccagcttctcagcctcatcttttgatctataagatgttatgcataaaggtaaaaaggccgaattgctatccaattttttgcagtccgtttcatcttgtcttgccattttacgtggcaatggctagtgcaatatgcaatgcgctaacgctgacattataacacaatatatttttctaccctccctttcgctgagttgcgaccagaatgtctgtttttcagtcatgtatttctttccgctttaggcgttcaggcaagcgcgttcagttgaaagcaaatagaacctataacgacgaatacgcttaaaggaagtatacaggaaatagaaaaagaagcgtactgcatgtactaaaaaccaaaaaaaacaccacatcggctctctggttgtatccatactttccctaaaattttgtaactcaagaaaatacctacataaaacgataatcagtggattgcactgatcaagtcgaaaaactccgtacatgcccgtctatccctgtctcatccatataaactgaactaggtagaaaaaaatacctaccctttctttaaccgcctggtatattaaataccattgtcaattgagaagctaacagccattgtaagagttatgtccagtgtccgactaagacaaggtaaccatacgttgatagctatgaataccccagaggaagattattctttctcataaatcctttttattggtttcaaaaatccaccaataagttcatatagcttgggcggctattcatgcgtaatataatgtgcatgaagtacgacccatcgactcttagagcaaatgcttcctaaattgaaataactagccgcctttaattcgagccttcttgtcatcttgtgtatttcatcctttcaacttctcctgttccacctttcactctaagcttccctatcatttggcctctttcaggttcgtccatagcgcatctttttccttttagacactccataacggaccaatcagcgttttgcgccatttatcggtcttgggtcacgtgcggcgacgcggaggctcccttataaggactggaaaaagacctgcaagaactatagttggttcttgaatatcaagtaatatattacttctctgtcgtaactttttgttgctttcaagttcaacgtcttttaaaaaccaagaaattattgaacataaataatatcactctaacacttattaggaaaccgaaaggagcaataacaaacatgttaggaataagatcatctgtcaagacctgcttcaagccaatgtctttaacttccaaaagactgatttctcaatctttgctggctagcaaatccacgtacaggaccccaaattttgatgacgttttaaaggaaaataacgatgctgataaaggccgttcttatgcttactttatggtcggtgctatgggtcttttgtcatctgcaggtgccaaatcaaccgtagaaacctttatttcatctatgaccgctactgccgatgttttggctatggctaaagttgaagttaatttagcggctatcccattgggtaaaaacgtggttgtcaaatggcaaggtaagcctgtgttcattagacacagaactcctcatgaaattcaggaagccaacagtgtggatatgtccgctttgaaggacccacagaccgatgctgacagagtcaaagaccctcaatggttaattatgctgggtatttgtactcacttaggttgtgttccaattggtgaagccggtgattttggtggttggttctgtccttgccatggttcacattatgatatttccggtagaatcagaaagggacctgcccccttaaacttagaaattcctgcttatgaattcgatggtgataaggtcattgttggttaggtttgtttttcgtcctcgaaaactacatctttattgtctatttgtttcacccttattttgatttttcatttactatccattatgttatgaacgggaactatacaactaacctaagaattttgaaatcacaacaaaaataatcaacatcacagtctcgaagggattacgctcaaaaaggaacgaaaatcactatactgtattccctgttgattttcctaagaatatattcttatacaatatggagaaaacaaaaggataagaaaagaaaggggaaataaagaagatttggacctatttattactacttttttgtctcaccatcttctttttctattcataatatttgatattcctttatttatctgcatgtatttataattaacgaaactatttatcttccctcgtcctgccttatccttcttttctccaaatgttttacctaagattggcctgtatttgaatattgatgtccagaagcagaagatttcacatgttgtataaagtatacaagattgtaaaaatgattgaagtatttttatatatgtatattacctataaaattttttatattacgtaccgaaggggtttttttaatgctaaagcgattcatcttgctgtaggtatatttttaaatcatctggaatatctgtccaggaattactatcccagtccatgaatttcttttttaattgggagtatttactgtcaaataatcttgaattgtatgtcgttgcaaaataacttgctttttgacccatgtggagttcctgcccttcctcattatcaaaaaagcccccattgatttcactcccgttgctattatcttgcttatcatatttatttgaaactttattactttttaaatcaataccttccaaatcttggaacaattgccttacatattccggcatattgtccggtctatacctacgatcaaacttaattctccaatagactgaccaatgtaaactgacatattcgggtacataacgagatcttccgaggttaggtgtatgaaaattttgccactttccttctttattttccattcgtattccaatggggagcagttccaatacccaccacaccaatctcataaatttatttgcatgtccacatttaagagtaaaagcatccttcactttttctttttcatctttcaagctcaatctagtctcttttatattttttagacaatcttccattctctcatttctgccagatttatcctctcgggctccatcctcattatcactcactcctagtagggaacatttctttggtgagttgaaactaaggtaatcatgtgtgtctgcgaataaagatccaatcgaagtgtgtttggtagcgaaatcatgtattgcaccaggtttgaatttaacaccaaatttgattgcctctgctaaaatccatcgcagcgttaaatttgacaagttctcttctgtctcacagtcaggcgcccaaccttcaccaacgtcagaatgatcacctggaaaccatttttcaatcaagtcgggtgtcatagtcattctacttgatgtaccgctgccttggatagattgaagttggaaaatggcttcaattcctcttgttgaacattctgtatctctcgcgtatgaattaccttctaagaatgagttcaggtccaacagcaactctgtagtttcctcgcttttgctcgataacaaccttccagggttatcaggaatgagtggagaaggattactaatagaatgtgcgccactttttaaagtgtattttatcaaaggattttccggggttagatcacgcattaatgcattagaagttggcaccggcgaacactggtcagttatatgattacaatatgtcaatgaaaatagtttcggaatgtacggcatcggagtgaaacataactgcttgaattttccacgtctttcatccaaggatacgcaatgtcgaacatgctcaacgatattgcttctctgggtgcaaggaaacaacctgtcccttaatattccaactgagttcacagaatcgaataagccttgaaaatgtatctttacctcgtaatccctagagaatgttttcttgaattcttcagccaaggtacttgtgtactgtaattcattaggctgcgaatcgtattcccatttttcatagatttgccatgccattttaaccatttcttccaaacctttactcaaaagtccgactctttcaatcattccagcaagaactcttgcaataaaagctcctctagaaaagccaaacatataaattctatctcctggttcaaaatacttcatcaaaaaaagatatgcagaacatatgtgattgtctaaactgaatgcgaacatagaatctaataaattttgtaagtgagaaatagttaaccgtcttctgacatcaacaacagcgtcaaatccaactgaaccaattccaggttggtaataacaaatttgttcagaactatcaccgttctcaagaaggttgtacaattttaaaatattagtgaatggctgaggtccaaaattttctcttgttccatcaaaacaaagaatgatattcttgccagacgatgaatgtgaggatggatttatacttctgtcgcctcccgtcccattttttttatattttccatgaatataattgaagctatccatctaatggatattatgttagtgtattattttttataagttacatcacctgtttgctgttattttactacatctgtctgaagtacattaatttgtggcggtttaacagtatattgaatgtgacaaacacacccagacacctcaatagacaacaggagggccattaccataatttcataacattaaatattccaagtaacatttttcagaagacgaagaaagactaattaacaggataataaatattaacattatcttttaagtaccatacttgaagcgtcaattgatgtatgtttggttttccactattttcctaaaagcatgaatcttttctaggcaaaaaattggaatgacgactcctgatcgttaaaatggaagacaaacactagaagttgacttcaaaaaaacttctttcattaaataagggaaatatccggccggctcatactgataatataccagcaacatttacaggaaactgcaggttttaggcagtgtggcgaaccgcaaataaagtaataaacaacaatttcaaacggaaaggactcctctgctaaagatttgatgtttttaagttcttttatagtttatattggcataagaggtaaaccatatttagcacttattttcataaagtattagaagtgttcttatatatttcattacccgacttgaaaaatactacgcggttcattgcgagaaccttcaataagtgtcgaaagagcacctacattggcgtttaaataataaacacaccaacctacatattacgttgaatttaaattctttcactgcttgtaaaccatagacaataaactgattaatttagtatctaaaaaatcttttaaagggaaagagaagaggcggaaagatgagtgatagggaattcgtcacggtagatcccgtcactatcataatcaaagaatgcattaatttatcgacagcgatgcggaaatactctaaatttacctctcaatctggagtggccgctttgctggggggaggaagtgaaatatttagcaatcaagatgactacttggctcacacattcaacaatttgaataccaacaagcacaatgatccatttttatctggattcattcagttaagacttatgttgaataaactgaaaaatctagataatatagattcactaaccatattgcagccatttttattaattgtgagtacaagttccatttctggttacatcacttccctggccctggactctttgcagaaattctttaccttgaatatcatcaatgaatcatcgcaaaactatattggtgcacacagggcgacggtaaatgctctaacacattgtaggtttgaaggatctcaacaactttctgatgattcagttcttttgaaagtcgtgtttttactgcgttcaatcgtcgactcaccttacggagatttattatcaaactctatcatatatgacgtattgcaaacgattctttcattggcttgtaataacagaaggagcgaagtccttaggaatgctgcacaatcaacaatgatagccgttaccgtaaagattttctcaaaactaaagactattgagcctgttaatgtgaatcaaatatacatcaatgatgaaagttacacaaatgatgtattgaaggccgatacaattggcacaaatgtagaatccaaagaagaaggaagtcaagaagatcccatcggcatgaaagtgaataatgaggaagctattagcgaggacgatggcattgaagaagagcatattcattcagagaagagcacaaatggcgccgaacaactagatattgtgcaaaaaacaacaagatcaaattccaggatccaagcgtatgctgatgataactatggattgcccgtggttaggcaatatttaaacttattactatcattgattgcgccagaaaatgaattaaaacattcatactccactagaatatttggcctagagttaattcaaacggcattagaaatttcaggtgatcgattgcagctatacccacggctttttacactgatatcagatcctattttcaaaagcattttgtttatcatacagaacactacaaaattatcactacttcaagctacattgcagctatttactactctagttgttatattgggcaacaacttacaattacagatcgagctcactctaacaagaatattttctattcttttagatgatggtaccgcaaataactcgagttctgaaaataagaacaagccatcaataataaaggaacttctaattgagcaaatatccatcttatggactaggtcgccatctttttttacttctacttttatcaatttcgattgtaatctcgatagggcagacgtttccataaactttttgaaggctttgactaaattggccttaccagaatccgccttaactaccacagaaagtgtaccacccatttgccttgagggattggtctccctagtcgatgatatgttcgatcacatgaaggacattgacagagaagaatttggcaggcaaaagaatgaaatggaaatcttaaaaaagagggaccgtaaaacagagtttattgaatgtaccaatgcattcaatgaaaagcccaaaaagggtattccgatgttaatagaaaaaggtttcattgcttccgactccgataaagatattgcggagtttcttttcaataataacaaccgtatgaataaaaaaacaatcggtttgctactttgccatccggacaaagtaagcttgttgaatgaatatattcgtttgtttgatttttcagggttaagggtcgatgaagctattagaattttgttgacgaaatttaggttgcctggtgaatcgcaacaaattgaaagaatcatcgaagccttctcgtctgcgtattgtgaaaatcaagattacgatccatccaaaatcagtgacaacgcggaggatgacatttctactgttcaaccagacgctgattctgttttcattttaagttattcaattattatgttgaacactgacctacataaccctcaagtgaaggaacacatgtcatttgaagattactctggtaacttaaagggatgctgtaatcacaaagacttcccattctggtatttggatagaatttactgttcaatcagagataaagaaattgttatgcctgaagagcaccacggcaacgaaaagtggtttgaagatgcttggaataacttgatatcttcaactactgttataactgaaataaaaaaagacacacaatctgtcatggataaattaacacccttggagcttttgaactttgatagagcaatttttaaacaagttggcccaagtattgtcagtactttattcaacatttacgtagttgcatctgatgaccatatatctaccagaatgataacaagtttggacaaatgttcctatatttccgcattttttgacttcaaagatctctttaatgatatactaaactccattgctaagggcactactttgattaattcaagccatgacgatgaactttcaactttagcttttgaatatggcccaatgccactggtgcaaattaaattcgaagacactaacactgagatcccggttagtacagatgctgttagatttggtagatcatttaagggtcaactaaatacagttgtttttttccggattattcgcaggaacaaagatcctaaaattttctccaaggaattatggttaaacattgttaatattatactaacattgtacgaagacttgattttgtctcctgatattttccctgatttacaaaaaagactgaaattaagcaacttgcctaagccatctcctgaaatttctattaacaagagcaaagaaagcaaaggtctcttatcaacatttgcttcttatttaaaaggtgatgaagaacccacagaagaggaaatcaaatcctcaaaaaaagcgatggagtgcataaagtcgagtaatattgccgcctctgtctttggaaatgaatcaaatataacagcggatttaataaaaactttactagactccgccaaaactgagaaaaacgcagataattccaggtattttgaagcagaacttttatttatcatcgaattgactattgcattatttctattttgcaaagaggagaaagaattaggaaagttcatacttcaaaaagttttccaactttctcacacgaaaggcctcacgaaaaggactgttcgtagaatgctaacatacaaaattttgttaatttcgttatgtgcggatcagacggagtacttgtccaaattaataaacgatgagctgttaaaaaagggggatatttttacccaaaaattttttgcaactaatcaaggtaaggaatttttgaagagactattttcattgaccgaatcagagttttatagaggatttttactaggaaatgagaatttttggaaatttttaagaaaagttacagcaatgaaagagcagagcgagagcatttttgaatatttaaatgaatcgatcaagacagacagcaatattttgacaaatgagaacttcatgtgggtcctaggactattagatgaaatttcatcaatgggtgccgttggaaatcactgggaaatagaatacaagaaattgacagaaagtggtcataaaattgataaggagaatccatacaagaaatcgatcgaattatcattgaaatccattcaactaacatcacacttgctggaagataataacgatctgcgtaaaaacgagatattcgctattattcaagctttggcacatcaatgcatcaatccgtgtaagcagataagtgaatttgcagtggtaacgctagagcagacgctcatcaataaaatcgaaattccaactaatgagatggaatcggtagaagaattaattgagggcggattactaccgttgctaaattcgagtgaaacacaggaagaccagaaaatcctcatttcatccatattaacaataatttcaaatgtttatttgcattatttgaaactagggaagacaagcaacgaaacgtttttgaaaattttgagtattttcaataaatttgtagaggactcagatattgaaaaaaagctacagcaattaatacttgataagaagagtattgagaagggcaacggttcatcatctcatggatctgcacatgaacaaacaccagagtcaaacgacgttgaaattgaggctactgcgccaattgatgacaatacagacgatgataacaaaccgaagttatctgatgtagaaaaggattaaagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggcctttataaaaaggaactatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagcatagcgaacgtgtagggcagcgtttccaagaacaaaacgctgccttgggacaaggcttgggccgataaggtgtactggcgtatatatatctaattatgtatctctggtgtagcccatttttagcatgtaaatataaagagaaaccatatctaatctaaccaaatccaaacaaaattcaatagttactatcgcttttttctttctgtatcgcaaataagtgaaaattaaaaaagaaagattaaattggaagttggatatgggctggaacagcagcagtaatcggtatcgggttcgccactaatgacgtcctacgattgcactcaacagaccttgacgctcacgccgtagcgggcgacaagtcaaacggaacaaccgttgccgttcccatcggagtccgacctaggccgaactccgtgaatttctgataacaacggtcggtaaagactggttccccagtatatttcttctctcaggagcaggggccaatgccaaaagcgacattaacccggaggacaaggctccactgtgttccaccgaatttcccacctgataatatctgataacccgcccataggtggggatccttctgtaaacaggtttcttaatcgtaggaattaccactgttccactgccaatcgcagctcccagagtttcgttcccagccgcgagcaccacagcgtaccatgtgcgccacgaggcctcaaacgtaaaacaatcgaaacgaaaagaaacagactataggggagtatagagacagccggccaataagaagaggaaaaagaaatactagcgtttatcaatgtgggtcgttaacatatcctgttgacaatgattacaggttaaaaggtagcgtaagtgaatattaactatggatattcttatacttagataagagacatataaaacacacgatgattgattgatttttatgaccaatatatgtaattcgtaattcagatagtttttatacttttaatgtgtgccgaaccatattactagtatatgtaactaccatgttatgttcaattggcagatctttaactcggctttagttatccaagttacttgcaatatttccttctgcgagagtacatttgcccttaaacgtatacgaggtattcattaatgtgtgttgtaagtatttagattgacatctataagagagatgaacatatatatatatatatatatatatatacatgcatatttactataaacgcggtttattctgccaggcaaaggcaatttgcttttgttcgccaggctcaatgataacgttgatgacacttgtttctcttttagtccgagaaagctgcacggcttgttggaagcatctgctcagttcgcttattgtgttgacaaaaaaatcattggcacccagtcctttgcctacgagatcgtaacggcagttcttgcttagtgccgttggaggtaaatcaccctctatatccttttctccatggtaaataccgctattgttcatcacaacgatgaccaatgccagctgacaccttactgccgtttcaatttccatggcagagaatccaaatgcggaatcaccctgaatcagcaccacatcgagttccggatgagatgccttgcatgcaagagcatatccgagcccaatccccatagtcgcgttggtccctgcgtctaaacggcgccttggagcgtctgtagggaatgaaatacgcgcaatatccatagtatttgctccctccgtcacaagtattgtcctgtaatcatcgataagaggcctcaatgttccataaacctggttgtaattcaattgtgcccctctagtcttctctttcctcaatagacgagtttgattcagttgaattttctctcgtatttcttgcttaacaccactatacttccagcaggaatcttggcgagtcaattcctcaactaaagcggttacgctcaagcctatatctccccatatggaaaggtcagcaccaggtgagacattgttatcccccaaggtttcgggattggaatcgaactggatgaatatggattctgagttccatttgggtgaagtaccaaaatgcaatatccagtttaatcttgccccgagaacaagaacaatatccgctattttcaatgcttgagatcttgcagatgaaacgttcagtggagaagagtctgggacaattcccttagccattggggtgggtaaaaatggtagattgaacgtatttactagtctgcggatttcgtgtgagttttttaccgcaccctttccaataacaatcagaatatttttatttttatgttgcaaaataagctgtacgacttttttgatcttcgacggatcagggccacatatgtttggagttaatatcatcggtaattcatttcctgtacggtcgtttccttctaagggtttttcatactcaataaaatctgcagggacgtctatgtaagaaacccctgcagtgccttgtatacagtaattcaaagccttctgagtaatcatgtcaatattgtcaggggttaactttccggtaaacttcaaaaatggggacaaaagactaacttgatccaactcttgaaacccgcctttatgtatatcactttgagaagaactccctgcaattactagaagaggccacctattactcattgagttgtatataccagccagtgcgtggattaaaccggggcccccgacaataagtaacacgccgggcttatcactaatataaccataagcagaggctgcatatgaggcagcctgttcgttcctgcatggaatgaatttgataccgttggcaaccatcgtatccgctagttggacaatagggatgcccacaattccaaagactgtgtcgatgccatatttttgtaaaagttgagcgaagtgttgggtagcggtcgtggtcatattgatggatggttgtgacggtttgaatgtagagagtatattcttcttatcacataaaagtaaccaatgccttttttttcctttatatataatgtggttatataccaaccttttgtaaatttccaacttttttctttagttagctttgcttgaacttcgggccgaagggctcggataagagaaacaataattttgttttcataaaacatcgatggcttgactacttcttttatcctgttcctgagattctttcatcttggcgatcttacaccttagttccataatagggtctcttacaaaatccctcattgaaacgacttgagaacacgctgcttgcgggcaatctcttgtcgtgtatccttgtaaatagttttgaatgccgtctctatcgaagacgtgattacattttcttgatatcaatggtgcttcgtaaggtttgcaggtgataggacaagtcaattcaattttaccaccttctatttgtagatcgtcttcgtctgcggggttttgcagatccggtattacacaagttggatcattccatatgtacggcaacacttttagtatcttgagtgtatctgtgttattaaccatggttgcaggctctggtgtgggcatatttagatataattcagataatttgggagcggtgagttctccggtacgatatttatcccaggtagaaaggtcgatttgcggacaggcatctgaggattgtttgaaatttttttttaaatctttaatatgttcgtcaaatgagttggattccgattcgtatgtcgagaggagtttgtaggtgctagtaatatctgcgacctgctcttcaatgccgatggtggaaggagatgtagaatccactaattgatttatggtctcatcaatttgtttgtagcattgttgatatatatttgataagtctcgggcatgtaaattatggaagtacttacctgattttgggtgtagaggaactgacttgggtataggattatcgttcaaggccatttttaaagttattctttttttatatagtcttgccttggtttctttaactgacacgattattttagcaagtttttttctacacaggaaaagaggaagaaaataaccagagaagcactggtaaaaagatacttctgcgtgccggagtaaccagaatcaaaggaacgcatagatggataaagaggtaagtgaattggtagtgttgcagctaatacacactttaatttccaacaagaatgaagaactggttaggaacgggggaggaatcaacatgattgggaataatcttcgaatatcgctagtcaagttgactaacgaaatacaaaacaatttgctaatcaacgagctgacaaatttaagaaggcaaagcaacgtggcaaatggaaacaggaaactgggcatcaacgatatcctgaccatagttaagaatttattcccagagtacagaacaacactaaacgatggacaacttagtctacacggtttggaaatgcatgatatcgagaagctccttgacgaaaagtacgatcgattcaagaaaacgcaggtcgaacaaataaggatgatggaggatgagatattgaagaacggtataaagaccggtgcatcgcaactgcaaccacatgcaaatgctggcaaaagtggatctgctggtaccagtgctactataactacgactacgccacacatggcgcattcaatggacccaaaaagagaaaaactattgaaattatacagagataccgttctgaataaattggaaagtaaaactgggaattttcagaagctattcaagagtcccgatggtagcattatcaagaatgagataaattacgaagacataaagaacgaaacgcccggcagcgttcatgaactgcagctgattcttcaaaagagcataacggacggtgtaatgcgaaaggtcattggtacggacgactggaaattggctagacaagtgcagtttgaattggatgatacggtgcagttcatgagaagagcactagagtaaggagatagtaggcgacacttcgaaaatctaaagtcttgtaacattactattatatactattttattaaaaaaatacacacacaattctttaacagaacaatatataacaaatgaagcgacatgtttctcaaaaaaaaacatagtaggtaggtaaaaatgggaaagaacgggacaaacaaaacgaagagcagggtgtatttgcccacacacggcaaacaacatccattcacgcccgcatgcccaaaacttttttgcgataaaacgcccacgcaaatcacatcgttccaacagaggaatcgaacagcacagatacaaagtaggaatatagcacacacacaggaaaaattaattaattattagaaattaaaagggttggggagaaaagaggtctaatttattcattaatattcagtaattgaaaaaaaaaaaaaagaaggataactaagagaaaacaacatcaagctcgtttggcttgctagtgatcgcttagaatctttgtaaacctctttgtctagcttgccattttctgtagataatggtagaaatgatggcgatacaagccaaaccgactagaataaaaactaagataacaccacctggtaacgtgctcatcaacatctttgtataattgttattgtactatttattgttttgtatgtatacgatggagaaaaagagaaaggaagaaggaaggacgaaagagaaaaaactggaagggaagaagaattgattttatattaaccaagaggaaggaaaggaaattgagttgtgattacggaattttagtttttttcactgtttatttaaaccaaaaggtgtggaagagaaagagagaaaaaagttctgtaattcgttaaggaaattaagtatccgcgccggaaaaatagcgagaggttttttttgatgcaaaagctagggagggctgcggacggatttcgaaaacagctcaacagcgtggtgacgagttgcgtcagggtgttggccagtgctaccgcgggcggcgctgcacagggagtaagcagagcgggctagagcgcggttttggagagggcccgggctgctgtggtcgtaggattgcggtaatttagtggctcgccctcgtttgtcgtgctttttccgagttccgaaactctttcccgagctgttaatgtgctaaaagtggtaaatcgtatatgatgatatacgtatatgatgataatttcctgcgcgctacttgcgtgcattcgtcactcataacaaaaagaactacacaatacgtaaacaacgtgcgaaaatatctatatacaaggggagaaaacaaaagtgaaagtgcattacagcccatcacagatcattataatacaatatgccgaccaagtcaacttttagtcgctggaagaaggcggacctaattgacctggccaacaagctggaaattgacggcttccccaattatgccaagaagagtgatatgatcgattacctcgaatcgcacttgaatcatcttgagaaacctgtggattttaaagacgactacccggaactaaggtccttttatgagtcgatgacagtggaccagtcaaaggatgaacggaacgaatacggatccggatctggaaacgggtctgggtctggatcctgtgacaccgccacaaatgattccgatctggagaaagcgtacatcaaggaggatgatgatgagaaaccgcaatcaggcgatgaaacaagcgcgacaaagccgctttccagcaggaatgcaaattcaaacgccaaaacgaacttcaatttgttggattttagcacagataacgactcgtccacctctgcgtttactaagttcaagtttaactttcaggaatacctctccgatattagataccaaacgcagaaattgaatgaaaatgttcaggactatctttccactatttccgccgtcgatacgattttttccttgttggaattctcttttctggtgagaaacatattagccgccgggcagccaacttcttcttcttcgctcgcatcgtcgctggaagccgccgttgccgcccataataaatatcaatacacgctcgatttctgtttaccaatactcacgtggctgctcttctttaggggtattccaacgttagtgtcatactacatcaacttcatccgctacgacctgaacatcgagttggacccgatgactttcaatctcacgaaattcttgatttctttggcaatcttcaaaacttgtaataataaaaacatagatttccattcttttcgatgtgttaaccaactatggacacaactctgtacagtgaaccgttcccttggtatggtacctctagtattctccatggttagttgtctcctcactctatacgtattatagtatattttcttacatacgtatacacacgcgtacgtaagccgcgaagtgtgtatttactactctgtattattgtaataaactcttctccttctttgtcttttcttctcccaaaagcgcacttgccttgatcagcatattgtatacttcgatgttttcaaatggaggtacgacttcattgttgaacatcggacccattccaatgaatatagatgccatatcactacagttgttaaagttgtatccatgtgtgcccataatgccgataggcacatcacccatttcttttacaatggcgtagtattcatctgcgagaatccagatatcgccgaccctatcgtcatatctgtgctttctgttatcgtattggaaatatttccagctcgggtcgaaatcttctttcaggatcacgtgaaacttcctcgatatttcatctccatatgctttctctaactgagcttcaatcaagtcacaaatccattgcttgtctcgagggtttttcaaacataccatcatcatggggccctcgttataaagatgcgaaataaatgcgctcattgcgtcggccgggaacaccctttcccacacaacaacatgctcaccgtcattcgcgttgacattgctcatgccatggtcactaacaatcataacattgctaattttcaacaagtttcttttttgcaggccttcaatcaaatcgagaaagaatccatcgacttcaccgatcagcttttgtagccgcttatctcgtaaatcgtatccaaaactgtgtccgtacgaatcaacattgggtatataacttatgaccaattctggcctatctttaagctgaggcatatctatgtatcggaaaatttgagctaatttatcttgaagtttttcccattgattgaatttcccaaaataaaatggcattctttccctaggtacatccccgtggtcctcatacacaacctcacttccaggccacatatgcgtggccactttatattcgccttgcgattcagtttgcagtagttgccaaatagggtcagccgtgttgctccaaattcttgcgtcgaggttatttggtctaaattcgctactcgtgaaattatcccagaatatattggaaacaataccgtgctcaatgggatattttcccgttaccatgctccagtggttgggaaatgtctgagtgggaaaacttgggatcatatacggtgcagtcgtgatattcatatcgtacggggaccgcaaattgtgcaagttgtaaagaaatggcgtgtattttgcatctatcaatctcggatggaacccatcgatagatatcaatatcgttaacgtcttgaaatcatgtgtgccgttgaagtaagtatttgatctattcgcaattgtccggggcccattatcaataggttttgggcacttcgaatataaaagcaactcaatgagtattataccgcaaagcaaaagtttcaataaaaaatgtcgtgatattgcgaaaggttttatgttcgtatcatcttcattatttttttcaaggtcaacaggttgctcgaaaagaagcatatcgtaagcacacttcgaaatggccttctttgttatttcgaaactgttttgtggcctgcgtgtttaatgaaccctggtatcaagcgtcacagtcatataaagccttaaattatcttccatcaacgcacagtaaaccgtctaattgatagaaaaactctcaacccagttatcgagtgtcgctacactctattgtaattagctgcaatcatcttgtttattaattatgtcattttattaccctggatttgaagcccgtctctttttccgcttgtttttttttttcaatcgctgagaaatagaaagaaaacatagttagctcgaatagtttagtcaaaaggcctactattgactgctttttctgcaaatccatgctctcaagacaatacagtaattcgtaaaagaaaccataatgtcacaatttgttggtttcggagtacaagtggagctaaaagatgggaagctcattcaggggaaaattgccaaagcaacctcaaaaggattgactttaaatgacgttcaattcggcgatggtggtaaatctcaagctttcaaagtgagggcgtcaaggctaaaggacttaaaggttctaactgttgcctctcaatccgggaaaaggaagcagcaaagacaacagcagcaacaaaacgattataatcaaaatcgcggtgaacatattgattggcaagatgatgatgttagtaagataaaacaacaggaagatttcgatttccaaagaaatttgggcatgtttaacaaaaaagacgtcttcgcacaattaaagcaaaatgacgatatattaccggagaatagattacagggacataacagaaagcaaacccaattgcagcaaaataattatcaaaatgatgaattggttattccagatgcaaagaaagattcatggaacaagatttcttcaagaaatgagcaaagcacacaccaatctcagccgcaacaagatgctcaagatgatctggttttggaagatgatgaacatgaatacgatgtcgatgatatcgatgatcccaaatacctaccaataactcagtctttgaatattacacatttaattcactctgcaactaactctccatccataaatgataaaacgaaaggtacagttataaatgataaggatcaggtactagctaaattaggccagatgatcatcagccagtcaagatccaactcaacatccttgccagctgcaaataaacaaacaaccatcagatcaaagaacactaagcagaacattcctatggctacaccagtacaactactagaaatggagagcatcacgtccgaatttttcagtattaactcggcagggctactagaaaattttgctgtaaacgcatcgttcttcttaaagcagaaactaggtggccgtgcacgtttacgtttacaaaattctaatccggaacctttagtagtaatactagcctcagattccaacagatctggtgcgaaagctctggcgttgggtagacatctttgccaaacggggcatatccgtgtcataacattatttacatgttctcaaaatgaactacaggattccatggtcaaaaagcaaacagatatttacaagaagtgtggcggaaaaattgttaatagtgtatcgtcgctggaatctgctatggaaacattaaatagccctgtagaaatagtcatcgatgccatgcagggatatgactgtacattgagcgatctggcggggacgtcggaagttattgaaagcagaattaaaagcatgatatcatggtgtaacaaacagcgaggatctactaaagtgtggtctttggatattccaaatgggtttgatgcgggatccggcatgccagatattttcttttcagacaggattgaagcaacaggaattatttgttctggctggcctttgattgccatcaacaacttaattgcaaatttgccaagtctagaagatgctgttttgattgatataggtataccacagggcgcctattcacagagaacttctttgcgtaagttccaaaactgtgatcttttcgtcactgacgggtccctgctattagatttgtaaaccaagaattactttagcctaaactggatacatacgtataagcatacggtaaggaagtgggatctgtagcggtaatgcaataatgtgttggctctcacaaatatgaaaactgcgaacatctatataataaggtaacggtataacagaaaaatctgaataatttctctttcccgggtaatgagcccttaaggaggactcaaaacgaaaaggaaaaaaatacgagtggaaagaaaaaatgaaccctttccagtaattgataataatacaatcattcattattagaaatatattagttctcaattcaaggcagaatagtgctgtcattgtgatcaaatttttgtgtgagtctgctttgctttctgtttttttttgttgactcgctgttcaatctcctacttttccttttgttgttaaaataaggtattatatatttatacaaccctataaaaagcaattagccaatttccaatcctacgaagacaggaactgagcaaactataagggtgttctttcttctgtactatatatacatttgcaactatgggttcatgttgtagttgcttgaaagattcttcagacgaggccagtgtctcaccaattgccgataatgaaagagaagcggtgactttattactagggtatttggaggataaagaccaattagacttttactctggtggtccactaaaggccctaactactttggtgtattcagataatctaaatttgcaaaggagcgccgctctggcattcgcagaaattactgaaaaatacgtccgtcaggtctctagagaggtactggaacccatcttaatattattacaaagccaagatccacagattcaagtggccgcttgtgcagccttgggtaatttggccgttaataatgaaaataaattattaattgtggaaatgggaggcttagagccattaataaaccaaatgatgggtgacaatgtagaagttcaatgtaatgctgttggatgcattaccaatttagccacaagggatgacaataaacataagattgctacttctggtgctttaattccattgactaagctagctaaatccaaacatataagagttcagagaaatgctacaggtgcattattaaatatgacacattctgaggaaaatagaaaagaattggttaatgcaggtgctgtgcctgtattggtatctttactgtcgtccaccgatcctgatgttcagtactattgtactactgctttatcaaatatagcagtggatgaagccaatcgcaagaagttggctcaaactgagccaagattggtttccaaattggttagtctgatggattctccatcttcaagggtaaaatgtcaagctactttggctttacgaaacctagcgtccgatacaagctaccaattagaaattgtaagggctggtgggttgcctcatttggtaaagttgattcaaagtgattctataccactggttttggctagtgtggcatgcattagaaacatttctattcaccctctaaatgaaggtttaattgttgatgcaggtttcttaaaaccattagtaagattgttggactataaggattcagaagaaattcaatgtcacgccgtatctactttgagaaatttggctgcatcatctgaaaaaaacagaaaagagttcttcgaaagtggtgctgtcgaaaaatgtaaggaactggctctagattcacctgttagtgttcaaagtgaaatttccgcatgttttgctattttagccctagcagatgtctccaaattggatctactggaagcaaatatcttagatgctttaatccctatgactttttcccagaaccaagaagtttctggtaatgctgctgctgctttggcaaatctatgttcaagagtgaataattatacaaaaattattgaagcatgggatcgtccgaatgaaggcattcgtggatttctgattagatttttgaaaagtgactatgctacctttgaacacattgcgctatggacaattttacaattgctagaaagtcataatgataaagtggaagatttggttaaaaatgatgacgacatcattaacggagtgagaaaaatggcagatgtgacctttgagcgtttacaaagatcaggaattgatgttaaaaatccggggagcaacaacaatccaagctcgaatgataacaacagtaataacaatgacacaggatctgaacatcaacctgtagaggatgcaagtttggaattgtataatattactcaacagattttacaatttttacattgattttcttcaaaagcgggactaggcattataatttttatcaaaattttcttctcagaagttttattttctttctctccatttcttccatctttttaatctttgtttcctttttttacatcatattacttctacctactctactctattctaatttcaattgattttttttattttatttttttttttgttaataaaagaagaaaaaacttaaaaacgaataagaggctgtctttgttccgtagtatatgcctatttccttctagaagtttgaagtgtcgtaaattttacctacggataatgttcgttacattgttgaatggcaactgtagtgaggtaatgttcaaaaagtgagaaagcgggagagaagggctacatacaaaaaccaattctagataacatctatatcttcgtttttagaatatattgtaataaaacacaattgataatacagttctctcttcgtcctctgatggtgggagatctattaaaaatacaagttagctgagcgggggaaaaaaataggtcttacccggattcgaaccggggttgttcggatcaaaaccgaaagtgataaccactacactataaaacctcttaattattgatttccacaataattttatcatatatcaacactattcttcacatagtttttttaatcccggtgtctctcatctgctaatgaaaatacgttcactcatatttcatgcaccttccagtagactgacccttcataaggttaagaatatcatggggaaattatcgcaatgcatgtctcttaaagaatacaagaatatataaaggcgaatcaacgattcttcacgataatttgttttcctcttaatcacacagcagtctgaattctatcagtggcacattaatccttgtttcaatgctcgtgtgcacatctgcgtaaatatacattcttacgttttcttatttaataatagtaggttgagcttcgtccaccgggtaatgctcccggagcagtggaattaaaaaaaaaagggtgagcaccggaaacagctatctgcgcttaagtatcactaacgtaaagcataggtaggatttccagttctgccacatttgataaatagtgtaatccgtaattatcaagcgagatagttttcgaatataatttagaagtaagagcaaaatattaatagtatttcataaggaatattggaagaaaggagcgtaatacgaaagatgaggtatgtttgataagatatatacgtatatttatatatcactcttctgagaaagtatgccatagaatgaggatcactaacaaagaaaatgtcaatgaacttcaaagatatcgtttaatgaaacagtagctctaaaagaaggatcgagacagatgttatgaaactgttgatgagtgatcatcaagtggatttaatcaatgatagcatgcaagagtttcatgtaaagttcttgggaccaaaggatacaccctacgaaaatggggtttggaggttacatgtagagttgccggataattacccatacaagtcgccaagcatagggttcgttaacaagatattccatcctaacattgatatcgcatcggggtccatatgtttggacgtaattaactctacatggtcgcctttatatgatctgataaatatagtggagtggatgataccaggtttattaaaggagcctaatggtagcgatcccttgaataacgaagctgccacattgcaattacgagataaaaaactgtatgaggaaaaaatcaaagagtatatagacaagtatgctacaaaggaaaagtaccaacaaatgtttggcggagataatgatagcgatgacagtgatagcggcggtgatttacaagaagaggacagtgattctgatgaagatatggatggcactggtgtttccagtggcgatgatagcgtagatgagttaagcgaggatctaagtgacatagatgtcagtgatgacgatgactacgacgaagtcgcaaatcaataatttcgagcacacacatatatatatatatatatatgtatgtatgtataagtatatatgatggcatactataccacacgtacgactataattacaaacaactatcaagcaactacaaggatctctgtgggctagtggcctgcgggctcaattttgctcttgttcctgaacggtgaattctgtagtctgtcatccaggggaagggcagggcactcatcaacaatgtgatagtcagaaagcaataatgttttgtattctgatgagctttcactatctcttccgcaatacccctttttgcctatattacggcatcatctttccccgcgttctcgtgggggccaaataagctttgtccaaggggctgttgcaacggtaaaggtagtcgagccaagtgacaccagcaaacaaggaaacaaggaagcaaggaaggctttccattttccaataacgacatgagtctatctatggtgtataaaagtggcaggcttttcctacattttttttccctgataacttcctgttactatttaagaacaccaaaccaagtataaagaaccgtcaagaataaaatgtacaacattccagataatgtcaaaggggctgtagaatttgatccatggttgaaaccgtttgccgatgtactttctgaaagaagatacctagctgacaagtggttgtacgacataactcatgctacgcctgatggttcgtatcagtcactcagtaagtttgctagagattcatacaagtcatatgggttgcatgccaatccggaaaccaaagaaatcacttacaaagagtgggcacccaatgcggaacgtgcatttctagtgggagatttcaataactgggataccacatctcatgagctcaagaacaaggacgaatttggaaattttacaatcacacttcatcctttacctaacggcgatttcgccatccctcatgattcgaagattaaagtcatgtttattttgccagatggttccaagatctttcgtttacctgcgtggatcacaagggctacacagccttctaaggaaacttctaaacagttcgggcccgcatatgaaggtaggttttggaatccagagaacccctacaaatttgtacatccaaggccaaagtttagtgaatctgtagattccttaaggatttatgaagcccacgtcggtatttcgagtccagaaccaaagataaccacatataaagaatttactgagaaggtcttacccagaatcaaatatcttggctacgatgcaattcaattaatggctattatggaacatgcttattatgcatcatttggctaccaagtgaccaatttttttgcggcgagctcccgtttcggcacccctgaggaattaaaggagctgattgatactgcacattctatgggcatcctagttttattggatgtagttcatagccatgcttctaaaaacgtcgaggatgggttgaacatgtttgacggttctgatcatcagtatttccattctataagctccggtaggggtgagcatccgctgtgggattcccgtctttttaattacggaaaatttgaagtgcagcgattcttattagcaaacctggcattttatgttgacgtttatcagtttgatgggtttagattcgatggtgtcacatcaatgttatacgttcatcatggtgttggtgccggtgggtcttttagcggtgactataacgaatatctttctcgtgacaggtccttcgtcgatcatgaagccttagcttatttaatgttagccaatgatttggttcacgaaatgttgccaaatctggctgtaactgttgcagaagatgtctctggttatccaactttatgtttaccccgctccataggtggtactggtttcgactacagattagcaatggctttgcctgatatgtggatcaaactaatcaaggagaagaaagatgatgaatgggagatgggaagtattgtatacactttaactaatagacgatatggtgaaaaagtggttgcttattgtgagtcgcacgaccaagctttagttggtgataagacattagcgttttggttgatggatgccgctatgtacaccgatatgactgtattgaaggaaccatccatcgttattgaccgtggtattgctctacacaagatgattaggctgatcactcactcgctgggaggcgaggcttatttgaacttcgaaggtaatgagttcggtcatccagaatggttggatttccctaatgttaacaatggcgatagctacaagtatgctcgtaggcagtttaatttggctgatgatcccttactgcgttaccagaatttaaatgagtttgatagatcaatgcaattatgtgagaaaaggcataagtggctgaacacgaaacaggcttatgtttcattaaaacatgaaggtgacaaaatgattgtgtttgaaagaaataatctgttgtttattttcaacttccatcctacaaacagctacagcgattatagagttggtgtcgaaaaagctggtacttatcacatcgtgttgaactcagatcgtgctgaatttggtggacataacagaatcaacgaaagttccgaattctttaccaccgatttggaatggaacaacaggaagaacttcctccaagtttatattcctagtagagtcgctttggtgcttgccttaaaagaatgaactctatactatattgcttactgaaaatcaagactcaataatttttttctcttcatgtattggtagatatctaaacgtacataacaaaaaaagaaaaaagtaacttggggttaaagaataattgactttgggcgaatagcagagctgtcattactgctgatgcttttttcttattttcggagaaaaagaaagccctgtagggggctcgaacccctaaccttatgattaagagtcatacgcgctaccgattgcgccaacaaggcttttttcttgggaaaatctcttccaaggtttaacctatactgtctgtgtatgtctaaaacgaagcattggttgttcattgattgcaacagtaatgaataattagggttattgaagagaatgtggattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagttattagaggcggtaatctatgagttcacataaagtattgatagatgacgtaaattatcggccggtaggataagatccaacagttactaagttagtgaccctgaagcacagtgatcataatgtgttggaataagaatgaaacgccatcacctatcgactagtatttatattactggtgtatatcaaggagaacgtaagaagatgagacgtaaattcgagaaacaattatcaaatataatggaatgagagaagagtgaaacgtatataatgaaagaggaaatatctcaacgttcatctgtctctcgtaatgtgacagaaaaagaaaatcgatcaaaaatatggggaaatattcatcatgtagaatttcaaatattttcattgtaatttctaaaattaatgaggaaaattcgatatatctggtatcactttattattccttcagcacgaaatgtcgagcgatctcgatgcaggaaccaggtataagtagcgatagtaaatttttttctctctttttaataatccggaaagtctcagttgcgagtgattgcagacagttgtatgaatgtaaaaaaagtaatgaaaacatttgggagtatttcaaacggaggttagagacgaggctttcgagcttttctattattttaagtgctgtgtttccggacgtgctcttcactttcttattttcttgataatatttcctgtaaatgttacagcagaatggttgcaaactcaataaaattctgagggcaactggcagagaaccttcaattttggaaaacagaaggaaccgaagccaggcataacgttgttttctatattttttaagtaaggtgttcatccagtagagatcaggttacatcatagcaattcattcatgaataaagagtatcagttttttaaatgtacagtattagccgctgaaatgcaccaatttgaggttatttttgaaacataacttgaagagaaaagacagcattagggcgtttcttaactagcgatgacgtgcttcgattgagcggtaagtggaaagtatcagtctgtgtctactcgtttttttaagacattgtatataatatgttttgctggttagataaatgcgtggtgcacatataatggatacatccgtagctatggaatccgctttcaccaattgtaaaaaagtctacaacgacacatgctatcggataggaacaagcaacaaattggaaacgtatgagaacgaatgaaggatatccatcaggaagaagcgatcagttaaggcatcagaaatttctttcaatgaggaattgacaacgtgtttgtataagatctgattacctatgtagttcggctgcatagatttcagttacattcacattaaagaagcacgagcgcatattgtattgtgaaagtaggaatcaattaccatttaccaaatactgttctaatcactttaatactatgttatattgtgtaagaaaataacacaaattacgagaagtagtcattgaatgtagaaaaagctgaaatgcaaggattgatagcataatatgatgaatgaataaagacgtataaaatggaaaagaaataatatgttgaaatattagtttattatttttttatctaatcccaaggagaatttctagcgtattttacttgataactgaacctttcattaagaacgcaaactcaatgtttccaaatattaattcatttcccatgtatacctgatatcgttcaattccagaattcttacaaagcagatactataaaaagtgaaggggagcgaaatgaatacaactttctattattttcagacggttaagagagtacaaatgactatcctttttgaattctctagcttaaaatgaatagttgattcttttgccaaagacgaaaatagttgccagtaagcatctcttatgaaataagtgttgttgtgaatagctcaatagagatgtattattaataagcctcgtattttcagggatcatgcgtagcataatggcagttggtaaggggaataagaatgatgattccattattgcgaataaaggtatttctgaaagtacatctaatgggctatttgaaaatttgtttaggattatggtaataaaagaggcattaacgccagaacctttattttatcactttttcgatatttgttaataatctaaatctaacttatatctaaaccttagcgtttgcattcttgatttctatatttttattcacaatatggaaaggaaaaacaatctcttaggttgtccaagaaaacttctctccctgtcatactcaaagtgttggaacaaaaatcaactatcgtctatcaactagtagctatactactaatatattatcatatacggtgttaagatgatgacataagttatgagaagctgtcatcgaagttagaagaagctgaaatgcaaggattgataatgtaatagaatttaatgaaacatataaaacggaatgaggaataatcgtaatattagtatgtaaaaatatggattccattttgaggattcctatatccatgaggagaacttctagtatatgctgtatacataatactatagccttgatcaacaatggaaccccaacaattatctcacaattcacccatttctcaactagtaacatgagtactcctaaatagggcgatattttaaagtttcattccagcattagctataacacgttaatatggtggagtcagctgagaagttttttcaataaataatgctcgcgtggcgtaatggcaacgcgtctgacttctaatcagaagattatgggttcgacccccatcgtgagtgttttttttatctattcctaaccagtaaataccagaacatacggcagattataaatgcgtggtgtaaaattctacttaagaaaattggcataaaaaagattaaattcttatctaagtgaatgtatctatttcgttatacacgagaatgaaataaaaaatataaaataaaaggtaaatgaaatcagcgttcgccaactaatttctttaatctggcaacctcattttccaagtgataatttttcgaaagcaattcttcaaccttgtcttcaagttgtttcattctttgcaactttctcgcacgagaacgcctggcggcttcagtgtttctagcacgttttagagcagcaggatcactggattcgggcacaattggagaaagtggaatcgaacgctgtttgcggttgtaagcaacaacacctagatgatccagtctcgattcgtcatcctttccaacatgatgtgacttcttaacgactgaatttggtttcttaacctttcttgtttgagtcagtttagcatcttctagaacaggagtgggtaagaatgaagttgtcgagacttccagattggatggtaccagagaaacttcttcagtggattcaattgccttatcagccaatgaaacatcgtcagtggtaactggaatgtcattgtcaaacaaggatgtccattctttagagttgtcttctaggttttcatactcaaacattggagttgaatcagtgcttgacgaaaagaaagattccactacagcgtcatctagctccggaattggcaaaacggtcttggcatcaggtgcagttgccgtttgtggaagagcaaaatcaaaatcaaggttcgaaggggtatcctgtttgataattggatcctcttcagtcttgatgaatttatcaaaaatcaattggccaaccattggtttggcagtagaagtggaagcagatacattttcgttggttgatttagaaccatccaatggtgagaaacccattggatttaaagcaaataaacttggctgatattcggacattttatttgtatttaatttattttcttgagcagacaaattggtaaacaaaactttagtaataataatgatttaattaatgatagtatagggaaatttttattggcgagtaaacctggataatttgacagaaaggtaaccgttacggaaacatcttgaataaaattctacgggtacatgatagcaattggtaacaaaacaaataactcttcaaaaaactgacagttttcaaaaaaagtaaaggactttaattaataagggaaaataaattttctctttcaataaatttaacacataattctcttaataattttctaataataatctactttaaaaacaaaatataatcggtttagcaagccatttttcaatgatctttaattttttaatacgatactgataataacttaataaactgaactaaaataaaatattttgttttgattgcgaagtagatgagtgagctgtgtggctggtgagttgtataattcgctagtgaaactgatgggcaaaaaaaatttgaatttaggggggagagtaacctgtgttgtgagtttttgttttgttttgttttgtatatctattatataagaagataagtactgtcaagaagtagaagattttaaaaggtaagacagcgagccgaaacttctttaaagaagactaaaatttcggaattggaaaaaaaggttggagtatttatcttccgtatttaaagtcggaaatttttcatctttttttttcaagatgtatgctcatgcactttattccccgaagatcttcgaaagcagttcaatttaattggctggagattggcgtttggagaggcggtgtgtatgtcaagaaaggcattgtcaacgcccggacaaataattctaatttttacaagatgccggtggtgttcggcattgtaaaaggtatgggtgctttgtgcgtccacgcatggggtatggggtatgggggcatcatcgattgttctccggtaacggaacacggcaatatttctgttctacagcttgaatacatgccgtggatctgtttatcaaagataatgtcatgtagcgtggcaagtcgacacagcaacgtgtggataatggatgagacgatagcgccactggttggttgtttgtaagcttcgattggtaacagtgggctaaaatagattgtagttatacccccacgtttgctgggtctcacgatccatatcagactgcccgcgtggggttaattctgaggtgttgagccagccaactcagacgttttgatgacgaagaacagaagatgcaagtcttctacgtatgcaatgatctgtccaactcaccgaaacaagaaaaaattttgcgttttttttttcctacaaatcccccatttattcggaaggtgtgggtggaggcgtagttttttgtttattttttcccaatttacgtagtcccgcaggtcggttttcctctcagtctccgtacatttcttattttttacgtttaaagttcgttaacgaggcaaaaaatggcctgtcttcctccttttccgccggcaactgtaactgtaaactgtaaaattgtaagtgtaattgtaattgtaactgtaattttaacgctgaattcttgcgcgctctcgttggttactatcttttcttcttaatcgaagtgtgtacagttatgtgccgtttgtttcaatttggctgaatcttcctcatcttgccccttctttggtgttttttttgcgcaactcaaaacctcgttactgcatcaaatttaaatttaagctagagagaaggtagtgagaaagctattttgtttatttgtattttttcgtttcccgatcgtttcccttccatttctgttttcgaacccttttattttctatctgtgaattagacagcctgttcaccggtagccttttgattgtttgtttgtcttttttaagattatcaatattatttaatatctcgcctcaactatcgacaatatagcctattttcttctcttttttggtccgcctctgttgtacgccatttctatactgtgttactaggataaaataaatacctgtactgcatcatctttcctatcaccatctttttccacaaaacaacatttcaactagacacaaggacaacgtaaatttctaaatggatatcgagcctactttcaaagggtacattgaagatgaagatgacgctttgcttattcttcaagcaactttggatggcaagttaaagcatataccaagaaggccttatgaaatagaaagaccttatttgatcgtatcaggtagtatattcgtttttattgaagagatatcgggcatcaagagatggactgatggcgtttcttggtctccatcaagaatatcaggcaagtttctaatatacaaggaactagacaaggaaaacgccgggtctaatgctaatgctacttcgagtggcagtactgattccgccgtcattacggatggaacttctggcgcgagaaataacccttcttcgtcgaaaatcaagctacctcctttgaagaatcaccagtttgatttgccacctactatgggccattcaagttttgagtcagagcaagacacctccatttctccatcaaaccgttcgaacttacctttaaagtatactggcctggtgaagaagacaatatctgtgaagctgaagagacctccattcaactcgattgaaaatttacatattgtctcttattattctgtaaaagatataaaacaaaattgtctagtgactcctaaagcttctccttttttgaaagatgttagaccttcacaggaactaattgtcgcgatgggaaatacaaccttaggcaacgtgaaaaacaattccactaccaccggtaatggtcctaataatataaacaataaaagcaactcttccactcccctgaatactgttatttccacgaataacaatagtgctaatataaatgctgctggcagtaatcaatttactagtgcaaacaaaaattattattataaaaatgatgaaagctctggatacccaatcactcaatttgctcccgcattaccatcaacaactttgatgtatacggcgaatccaccttatatcactcaatctcctgataacactaacgctactggtatgaatacacatgttaataataacaataataatagtaataacagtagtaatagtaataatagtaacaataataataataataataataataataataataacaataataataatattaataatattaataatgtcaatactaatgcagggaacggtaacaatccaaatagattccataacgcctcttttgcttataacaccaccggtgactttattaatccgcaacaacaaggacaaatttcttatccattttattatacaacaattccgataaacaatcctaactattataccacacaacctccaaaccctgtaacaaacgcttcaacgaacgagaatcaaggctattccacctcctcaactcaacacccttattatgggcatcctactgaaagtcaatcagcatcagcagccgcaggcgctactggcactcctggtacagccgagaatgtccttcccgtatccagtatgcagccactactccatcaagccaataataatagtgcaagctctgctacctctacagctccttatccggtgtattctatgaatgtgaatgttccttattacaattcttctgcttctgcatacaagagggcacaagaaaatactacttcaaatacgaatgcagaaccttctggtgctacaagcactaactcaggcaccatgctatcaaatcctgcatacgctaattctcagtacactccatcgcaagtgtattaccagggattcccccaatatgccatggcaagtgctcaaaatccgtctatgtatcaacaccagcaccaacatcctttgcccactgtatatccaatagcgacgcctcaacaaaatataatgagctctggtcacactttgagcactattggatctgatcctcaacatcatcactatcaacaagagcccaacgaccacaaaaacttcgctatgggtcacgcgaacaataatatcttaaacatcaccaataatgatacgatgaacaacctcaatacaaacacttcaactactacacaataagtaaatatattttaaaaaagtactccgattttcttttcttctccttgcctttttgagtatcgggtttactcatgaaaattatatcatttttcattttacagttttatatacttcgcttctttacgtaatcatgcctttaatttcatcttcatttgcctatggaaaaaagctattccttttgacatcataaaatatctttattaaagaatcccctctgtcaacattttctacgaaagatagcttagtgtattttttgaagatgctgtcgaaaatgattctcgacatactcgcgctggtggaaaaatgaagtggaaaagataagcaaattgatatataagcaaataaacatataatttggacgtacatcgaaattagttgttctcaacttattttcattgtttgatgaaaagcggaatatacatcacggctatataatgaataatggagacaataaaacgacattagaaaactcaaaaaatgcgtcactagctaatggaaattatgcgattcccacaaaactaaataggctgaaaaagaatgctgaccctagagttgctgcaatttcaggtgctttatctggtgcactatccgcaatgctggtctgtccttttgacgttgcgaaaacaagattacaagcacaaggtctccaaaacatgacacaccaaagtcaacattataaggggttttttggtacatttgctactattttcaaggatgaaggtgctgctgggctttataaaggtctacagccgacggttttaggttatattcctactttgatgatttacttttccgtctatgatttctgtagaaaatattcggtcgatattttcccacatagtccgtttctctcaaacgcttcttctgcaattactgcaggtgccatctctacagttgcgacaaatccgatttgggtagtaaaaacaagacttatgctgcaaacaggtatcggtaaatattccacccattataagggtaccatagacacatttagaaagatcattcaacaagagggtgctaaggctctttatgccggcttagtaccagccctgctggggatgctgaacgttgctatacagtttcctttatatgaaaatttaaaaataaggttcggatattcagaatcgactgacgtatcgacagatgtgacgagctcaaactttcaaaaattaatattggcctctatgctatctaaaatggtagcatctaccgtgacttatcctcacgaaatacttcgaactcgaatgcaactgaaatccgatcttccaaatactgttcaacgccatctccttccattgattaaaattacgtataggcaagagggcttcgccggcttttactctgggtttgcaactaatttggtaaggacagtacctgctgctgtggtaacactagtatcgtttgaatattctaaaaagtatttaactactttttttcaataaagtgaaacagaaaaatgtacatgacacaagctgagggtcgtaaaaagcatctttcgcaattgtttcaacctcatgacccctgtcttgactatgtattcctctttacgtcgggctactcgcaaaatcaagtagttttaaacctttagtatgttgcaaataaagagcaaaaaaagaatttattcatcccaggaatctcactacatttcgtaggggaagaaatgtagatttgaggttcatttggctcgtgagaacgacttgaaccttattcatactttatataatattttaggagtattgtagcattatgtatatttttcttgcgggtgtgcactgccgaaatagctgctgaatatccagattaaaaaactaaacaaaaaactgtttcttgttcgaatagtaaaagaaggttttcccaaatgctattgttatttagaaacgctggaaatacagtattttttgaagaactatccgttttacccgaacctattttaattcaattcttaagtactaattaaagtctgcttaatacatatagagtatatcttacataccattaacatgtaagttaaattttaagtcaaagatattgagttttttaaagaacatttggtgtatgtgaggccatctgcgctaatattttcaaaattagtttcaattgaagggccacttgttgtgttgaattttgggggtagtatttttttgcaactagatatgttatcgtcatgagtttgaagtggagctaaagaatcactctgtagctcgttctccccgtaaaaactatttatgctctctgctggtaattcatcgtgttctaaaagaggagagggcgaggcattttcgtgaatgctagcttcactagtagcgataatactcttcgggcaagatttatgcaggaaatcaaaaagaagtggataatgtgccacatttattgagtcatctttcaataattgtgccttcttcgggaggtttgcattcaatgcggtcaaattgttaacaatatctgaaacaatatcattgacacatgcgagttcttcatttaacgagccaatttttttttccgcattggccaatagacgatcatttccattgatacaattagtagaagccctttgctttaagacgtttttgtaactatgttctaccttttttaacgactttttaagttgaagttcaatttgctgcatctgattgcgttcctcgtcaatgtccctacttacaacttcatagatggacagaatgtctttttttacttgtaataactcatacttcgtgctattgaagatagcagcctgtgttaattttttatgggatgcaaggggaggtaagccctttaactcttcgtaataggaactgcttccaacggcatcaaattctattcttgatttccatttcagtatacctttagttaagtctgctaccatgctaggcactctctgcctttcttatggtttggttacgcatactcttcctttatatattcattgtcatattttaaggaagcaatcgctcccgacgcaaagtaaaaatattcagtgctttgcactccagttagaaaaaatgaagagaattcaattgagaataagcagggaagtaattggattgggagaatctaaaaaatgtggaactcactaaaagcattcgctctagtgttcggaggttgttgctccaatgttattacatttgaaaccttaatgagcaacgaaacaggcagcattaataatctcattactttttgtcaatttttatttgttacatgtcagggactccccgaatttctggatgttcatcaacctttcccttacttcaagcctctgaaaactccacttcacgtttatgtcattactgtcgttttattttatatttcatctacgacgaataataacgtatttaaatacaacatatccattccgattcatatcgttttcagatgcttcggaaccgtaataaccatgtttacatgctggttattaaatggtaggaaatatacaaagattcagattttatcaacactatttttaaccattggagctataattgcctcattattcaaagatgctgattttcggtaccaagatttgaaactgcaagcgtggaaaattggaagtgaccaatctgtagatctcacttttatttttggcatttgtatactagtactttcatcattcacatcatctttactttcagcatacaatgaacgtacgtatcaaaaatatggaaagcattggaaggagaatatcttttacagtcattttttatcattacctctctttctatttagtcgaaagcagttaattcacgaatatcgagtgatgagaaagtctgaaagaatattgtgttcaaattttggagggaagattctagtcccgcgagaagaaactctccttcttttcaatgtgttaacacaatatttttgcgtcaagggtgttaatatcctcgccagtaaaacaaacgctctgacactttccataacattacttgtaagaaaatttataagtcttttactgagcgtccgacttttcgataataacttgtcatatactggctacatcggggtctacctagtcttttttggtgcctttatatactcgctgggatcaattcaccccaggcaaaatgacaagggggcgataaagaaaagtaaatgaacacacattataaactaaccttaaatcctacttgtatgttccttaactctatattagtggtgttgacgtaagtttagataaaatcgcgaacgctgccgcctggaagtaaatgaaaaaaaaaaaaaaaagaattcatcacctaaactcactaatctttaaaactcattcatgagaagtggagaactatattacagctatggaacaaaggaacaacggtatgcaaaatttcgatctctgggttttaataaatgcatgtagccaattttatcttactaacaatctttgtgttttctctgtgtatagtctttcaagcaaaatataatgaatacaaacaaattttggaagaattgcaaacaaaaatcatagaattaggtcatgacaaagatgaacacactatagtcataaaaacactgaaagacgctgagccgacgagaaaatgttacaggatgataggtggcgcacttgttgaaagtgatgttcaaacgagtttgcctattcttgaaactaagaaggaaaacatagaaggtacaataagtaaaatgaaagaaaccttaatacaaactgcaaaagagtttgaaaaatggaaaaaagacaataagattcaagtcgttaaaaactaaaccatatataaaatctattgcagtacttagtttggcaaaaaatataaataaacacaatcaggtactcttatgtatttatgtgagccatttataaagaattataaaggatatgaaaacatatattagtttgtttttttgaatgtttcaagtttcttgccaacagaggaagtcgtaacgaaagaaacaacaaaaaatatccacgcaacaatgacgccacaaatggcgctaatataaacccaagaattgctgatttcccaacttcttgggtattcatcattagcaaggtgacggatagctttaacgtctttgtcagtagtgaacgacaggccaatcttacgatagtcagtgaggaatgtaaacactccatggcggtctggaaggatgaattcaccggtggtgtaatactgagtttcagaatcgtttccgcttggcgacaatgttagacggtagtacggatccacttgtcttagttcaaattggatatcatcagcgatatgtggtagccattcttctccattccattccgaaaagcctacagaataaataactttgtccttgattttgtagggctcttcgtcataactagtaccatccgcatgtgaatgaaccgcatgcacacttttgattacagatttttcattaaatgtccattttagtaattcttttgcaaactcctgattagagtcctgatttttgttctttaagaaatcactactgccgatccatactaaacgagcattgtttaagttctggaaaccaactacaagaaagccttgagatccgctggtccaagagttgcatttgcctttggactcagtaaaggatgttcttggagcgtttaaaattgggacgatttgttcacgattttctaataaagcagctgaactttccccaaaaacaaaatcctcgctttttctggcgttgtacacatatttgttcagaagatggttagaagaaaccactagctcttctgaggagggcgaaaaatagtcacgaataacgtgtccttttggacttggatagatacctaattcattcaaaaataaacgaatggtattcggaacagcacctggagaactcatgcataaaatgttaccttcattttcaaaaaatttaatcaactgcttaactgggatttgtctcgctaaattcttgcctcctttggtaggaaaaacgatgatgttatcaaacaatctttgctctttgtcatacaaatccacagtagtggaagtactgttaatatctaaatattcaagtttgtaattcctttgttctagatcttttaaatagactgagtactcctctaaaggttccgtagattggtcgtaaagaacaagcgttcttgaagtttgtgtgcccacaacgaaaatggcctgcagaaggatacaaaagaaaaaattccaatcggtccgcatcctaaataatcaaaaaaggataattcaaaatttgcaccgtcaattgtgttaaagtattcaactttataaccaattcagttgactatacacctctttaaaggtttctcttttcaagaagcgtgtttgatatttttcaggcgtagcttagggtaatgcattattcaataacccgccctgaaaatatcgaaagtagatattgggatatctttaattgtagtatactaatatgtatctataaaacaatgagagccccctatcatcatccagagatcttactccgccatttttattttttataggtttctggcaaccatgattcatcaacttttttgacagtggcactcttcttggaaggtctttgatttgttttagacttcatgtagtaataacttacacctccgatgatggctagaaagatgacctgaactgataaaaattgtgggttgaaaaaggaaataggtgggctaacaatttcgaatagggttggtggtgccgcaattctcacgatttcatcgaacctagaagctaataaaaatgggattaaaaagtattgtccttccggtaaatttaacgtaacgtcttgcccgaattttgaagttccgttgacctccatttcgtaaggcccaatactcgcacctgtaatgtccgccacaggataaccatgtggatatgtaacaattgttccgttgacaccaaaaattgtgatattagtatcttcccaattagtaacattataggctaaggtagcggtatcctccgcgtaaaactcaaggaaagaatcatgattttctgattccttcccaacgacatcatatttcacctctatattaatagaaggtggcgctaccgcctccgcaacttcctgttcatgttcgacattgtcgctattattagctgatatggcagcacagaagctgctcaaggcagttaataaattaaacccgattaacatagaaaacctcataattgccagctataaagaagtgacagtgaacttttacttgtttcttttgtttaaccactagtatgtaattgtttttgcagaatttgaaacttcaccaaaatcttcttaacgttcaatgacaaaattacttacccgaactaccgaactacgaaacatgaataaataaactggaggcataaactcatttccaaattcccggaatacatcgtgtagtcaagcagcatacatcactatcaaaaatcatgcgcttgtgattatcgtatagtgtatttatataatatatatagatagcgataaatggcaagatcctctatgataaaagtcatcataatgaaaacagatggcgcttgtctactgtttgcaaggcttgaaatcacaggtttttattatatcgtggatttttgccattgcctaaatcaaaaataatgatcgattttttgtgaattagggaacggaaggaaaaaatcagcaaacagtcagccctagcaccataggccgacagcaacaaaaactgtttttttattctcaaatattcatgatattgattacaccgtacttcttttcaatgcgtaaacaactagagttgacaaatattataaactaaaaactatcatattaataatatacctcctagcacttcgtaatgtttctgtcattgaatggcgagaacataattttaaagaatcaacaccttaaattgttaaccttaacaaatgaagtaaattcaaatatttactcttgaattctttttgctttaactaacacattgaaatatcaaattagtccacttttcttccttgttgaatgggtttcttcattaacaggggaacgcttgcctaccatcaagcccattcaatgcagatgtgattaattggtaaacaaagggccaagcaaaaatacatctctcctacatgctacataagtccgagatatgttttatttaagaactatgaatctgtaaatgactgattcaatattaaactaaaatttctatgaaacatcaaattaatcacgtgctttttaaaaaatataaatttaatttcattttctatttcaatatttattaaataaaaaatttgaaaaatatataaaaattgtagcagtattagatttccgaaaagaaaaaaaggtttcaagaaaaggaaaagaaaaactaaacgtagtataaagtcttgtttagtgcaagccactgttggcgtttcaactaaactattccttaaaaataaagtacaatgttactgctaaacaatgttgaaggtgagcttaagacagtaaatcaaggaaatgcggtataattcctgctgacaaagccgcacataaatagcagttgttagctataaggagatttttagctacgaacatggttgtaattctctttatcctgattaccttcaagattaagaaaaaaacaaccatggtaactactttggctcaaagtcaaacaaaacttttaccatttcacggtacacgtttccgataaaatatcactagctattcaatgtctgtattcatcgataagccagagtacgacgtacaaaaaataacgtaaatgcatatcctgcatcaagaaagaacccttatggacgaacaacgaaagagatctaaatttagaagacagcaagactaaccatttgatagcgtagtaaggcttatctagaaatgttggacagataggaagagaaagtataataatggtgtatggtagatgactctataatcgtggtcggaacgtgcaatatatgagaacgatgaatgcatatacatatgtcgcgactcctttttttccattatagcggcatcgctttatttcgcgttttaattcattttcttttttcttcatttctttctgcatatgcaaacgcggcaagaagtgcccacggatccgaagaaaacctaatacattgaagtttctctccctgagataggaactctctcttctgcgtcagaaaaaaaaaaaagtactctttctgcatatattgctcactactgactcactgatccttttacgaatagttgggcaacacctattaagttgtaaaacaatcgcgaaaaaaaaaagaaaacaaccaaggcatcccacttttcgaaccctggcgctcggaagacttaatcattgcgaggtctcaattggccggaccgccaccatgcagaaaaatggtggaaagtgcgtgcgcgtttctcgtgccacgtgcttttaacctaaataggatacaaactatcggcttatctttagacacgctctcgcagaacgatgagctactgacattttgagttgatattcaaccttttaaggtatctcagaatgaggctccggcgccaccgcaaagtctaccttttcttctttaagccttgagtttcttcttttgcgaaaacgttgcaatgtattaggcaagattatattaaggaggtattataaaaaggactcataagtgaaataaataatattcgtaatgctaaatgtcctggtcttgcttcgtactctcgaaaaacgtaatcttgcggtatttaacgctagtttaagaaagtgttactgtgtattaaatgttggcactccggagatttatattaaaccaaaggtctttgagatcgtgtaccataccgattctagtcggagccttgatcattattctcgtgctattccaactagttacccaccgaaatgatgcgcttatacgatcaagcaatgtaaacagtacaaacaagaaaacattgaaagatgcagatcctaaggttcttattgaagccttcggctctcctgaggtcgacccagtggatacaattccagtatcgccactagaattagttccattttatgaccagtctatagatactaaaaggagttctagttggctaatcaataagaagggctattataagcatttcaacgaattaagcttaactgatagatgtaaattttatttccggacactgtatacgctagacgatgaatggactaatagtgtgaagaaactggagtacagcataaatgataatgaaggagttgacgaaggtaaagatgcgaatggaaatccaatggatgagaaatccgagagattgtatcgccggaaatatgatatgttccaggcatttgagagaataagagcctatgatagatgttttatgcaggccaatccagttaatattcaagaaatttttccgaaaagtgataagatgtcgaaagagagggttcaatcaaaattaatcaaaaccttaaatgctactttccctaattatgatccagacaattttaagaaatacgatcaattcgaattcgagcacaaaatgtttccgtttataaataactttaccacagagacttttcatgagatggttccaaaaatcacatcaccttttggaaaagtattagagcaaggcttcttacccaagttcgatcataaaactggtaaagtgcaggagtatttcaaatatgaatacgatccatcaaaaaccttctgggccaattggagggatatgagcgccaaagtagccggtcgtggtattgtattgagtttaggttccaaccaatttccattagctgtcaaatttattgctactttgagatttgaagggaatactttaccgatccaagtggtctatagaggcgatgagctgtcgcaagaactagtggacaaacttatatatgctgctagaagtcctgatttcaaaccagtagaaaataattacgataattctaccaatgttccacaagaaatttggttcctagatgtttctaataccatccaccctaagtggcgaggtgacttcggtagttataaaagtaaatggctagtggttctactcaatcttttgcaagaatttgtctttttagatattgatgctattagttatgaaaaaattgataactacttcaagaccactgaataccagaagacaggaactgtattttacagggaaagggcgctaagagaaaacgtgaatgaaagatgtattgctagatatgaaactctattgcctagaaaccttgaatctaaaaatttccaaaactcacttcttatcgatcctgatcatgctctcaacgaatgtgacaatactttaactacagaagagtacatattcaaagctttttttcatcatagaaggcagcaccagttagaagctggtttatttgctgtcgacaaatcaaaacacacgatccccctagtgcttgctgctatgattcatttggccaaaaatacagcccactgcacacatggtgataaagagaatttctggttagggttcttggccgcaggtcacacttatgcactgcagggagtgtattccggagctattggtgattatgtaaagaaaaccgacttgaacggaaagaggcaagaagctgcagtcgaaatatgttccgggcaaatagcacatatgtctactgataagaaaactttactttgggttaacggtggaggtaccttttgtaaacacgataatgctgctaaagatgattggaaaaaagatggcgactttaagaaattcaaagatcaattcaagacttttgaagaaatggaaaaatattattacataactccaatcagcagcaaatatgtcatcttacctgatccaaaatctgatgattggcatagggcctctgcaggtgcttgtggtggttatatatggtgtgccacacataaaaccctcctaaagccatatagttataaccacagaaccactcacggcgaattaataactctagatgaggagcagcgcctacatattgatgctgtcaacactgtttggtcacatgctaataaagataacaccagatcattcactgaagaagagatcaaggaattagaaaattctagacacgaacaaagctagaatgcattaaccagtgttttttctaactgtttatggtactagcctttgtgaacatgtatagtaaagcatatcggacgtagttttttaagaaccttgtttattacactttgacggttaggagttttattggaattacctcactttgcacataaacctctagaaaagaaggtaatacacaatgctttcgatcgatttgataaataatagtaattcatattggcataatgctacatatacgtatatatattttttttactcttttaataatcaaattaacttaataattgttgagaatctggtgaaggttttctttttcttttattttttattcttttttttcaggcaagttttatatttctcttattcagaaagtctacgtcaaagagtcattgaaagcttttatcttagataaaactattgggcttccaacagcataaaaaggccgcttaagtacctgtgataataggtactaattataatcgtaatgtttacctgatattactttctagtgtaaataactgtgcagtaatcttttgggtaatttcttttcatatttaactagtgcacatactcgcattatgaccattgtatgcgttcaatactaagggacaataaaacaagcattatactatatgttgtattgcttccaatgattgaaaaagcaacagttaccgctacaaagggtactatttactcaaatctataaaagaaaccaagccatatatttgagataagcggcttgattagctctactttatattcaatagcgtgctgggtaaaattctatttgttattttattggtttaaacgttacccgaacagaacacttttatgtaaatttttttttatcgacactttttttcagaatggaataaaaagaaaaataggcgatgagataaatttataacagtcgtcaattctcaaaaaagcagagttcaagatattgagtttaatatcaaactgcaaatacactaagtaaaaaaagttgcatacaatgacatccgttagaaaaagaaagatgaacagatcttctgttgggaaagcaaccaggagaaacaaagacaaacaaagaaagattaacatccagtctaatccgattattgcagcaaattgggactattcactgacaatggcacaaaactataagaaattagggctaagggctaaattacaaacaccagcaggaggcaaagaggccgatttaagtaaagtagttaaaagaattccattaacgaagcctgtgttggatgaagatgaagatgaagatgaaggtgaggacgagcaaaatgattataatgcggctaccgtggagctcgatgaaaatgagataccagaaggtggggcaaggatacagcgtgataagaatggtgatgttgtaagagttgtttacggtaagaaaaagaactttgatgctgatgaggatgttaacgaaataaaagctagggatactaccgaggagaccgaagtggttaagaaattagaagaacttgcgtctagaccagttatcagaaaggaacgtagccaaagtgaaagggaagaagaatggttggaaaaattatataagaaacacggtgatgattataaaaaaatgtttttcgataagaagctgaacatctaccagcaatctgagggtgacttgaaaagaaggttattaaggtggaaaaaaagaaacggtattgcatcaaaataaaccaatggcaactaccaattgattaccacgtaatatttatatatgtatctatatatgtttttatgcatcaatatcaagtgttttagagaacagcaaattatgtttgatatttccattccactatattatagaacgtgagaagcaaatagaaaactgtgaaataaagtagacttcaaataaataagtataatattttctctattatagatataagaaaattaagaaatagaaagaaagctaatttggttccacaaaggctctataggtagtaaacgcctcatcttcagcttccaaatcaacaggcaaatgtggagcgatgaaaaagacaaaaccgggttcagctttcaatttttggccatctgctttaatgtaaccattaccttttgtagtgattaagatacttggaccatcaacaccttcaaaatgcctttgaccaagtttctcatcaaaagtagtctccaatacagcaaattcttcgattggagggttatataaaactgacttaccgttaccagaggacctgtcgaactttaaaggctgcattttttgcttttccacaggatcatatgtataggttaacatggagaccaagtttttaacatccttgaattttggagtgaagcctgctctaactacgttgtcagaagcagccatacattccataatatcaccgcttatataggcgtgaggatccttagctcttaaaaagatggcttcaccagcattcaatctgcagtgattcaacaataaacatccacaaaacaaacccacgtcatcagggaactgtttattcagtctttgaattaattctggtaaatcaggtttgttaaagtctgatggagaattctttgatctttcgaccaaggagcgagcttgaatcttgattttgtcatccgaagcgttcatgaccctgctgaaaacagcttgcaatagctttttgttttgctcatcttctggggaacctttctgagcagaaggttgaatgttctcaataaaattcctggaagtttcttcaccaacaatgttgcgtaattcaggaatacgtttcaattcatctgcaatctcttgcaaaggtttgaacccgcagaaaccttcaaagtcagtcacagcgatggccatttcaggtttgtgattatcatcaggatagttcttaggatcttgagcgtgcaatattttacccaaggctttgtcgggatgtgcttgaatagacaagactttttcaatggacaaaactttgaaaaggaagggcaattcatttgtggcgtggaacttatcaataatgtccttacctaacatggcagaggggttcttggagatgatatctctcagggattccttagactcatggttgtaggaaggcatcttgctgtgggtacccatccataactctgcatatggtttatcttgttcaatttgaacagaggggtcagaatgggcagcaaattgagcgacagctgaagaagagccgattttaccccagtcgtattgttggtagcctacatagagtcgtacgcgttagttagtgtaccaaaaaaaaaaaaaaaaatactcaaagtattcaaaatatttgacgaaaaatggcacatacctgcatctaacctgaacagcttgttggacatgttttaaaattttctggtctgatgttctttacgtgtttagtgttgaatgattacaagaaacaaacattttatacagaaatatactaagattgcgacgtgtatatttaaatacgtaaatcgcggcgaaaaaggacacggacgcgacaaaaaattgctacaataaccaagcagcacgaaatggatagtgcaccacgagacttggcatgatcaaagtgcaaaagaaagcagaataacaaattactcccgcaaagtactagctatatcagggaacgactttattggcatcttgttgtagcaaggttttcatgattctcatccttgcgcttgtcgcgcggcacgatgccagtgcggagtttccgcgatatgatgtaactgcagctgttggtggcgaactttgcataagatcgacctcctactgatgagaaagataggatggattatatagaagagcacaagcaacgatgaatgggttggtattaggcgctacaggtttatgcggaggcgggtttctgaggcacgcacaggaggcaccccagttctctaaggtatacgcgatcttgagaagggaattgccctttccggccactgataaagttgtggccatagtagaaagggataattcaaagtggtcacaattgatcaccaatgaaatgaatccgcaggtgctattcaccgcactggcaacgacaagggcagctgcaggcggtttggacaagcaatacaagatcgatcatgatttaaacttacaattggcccaggctgccaaggaaaaaggatgtgaaacgatcgttctcgtttcttccgctggtgctcatccggactccaggttcggctacatgaagatgaagggcgagattgaacgcgatgttatcgctcttgattttaagcacactataattttgcgcccaggccctctccttggtgaacggacaaattctaaacaaagcggatttggcggcaatctgactgctgctttgggcactcgcgtgtaccgttctagattccagaggttgctaggctatccagtttatggcgatgaggtaggaaaagttggtgttcatttggcgttgaatacttctgggaaagacaaggttcagtttgtctccagcaaggacattcttgacatctcagcttctctggagaagattgctacctaaatcaaccaacggcttcttctcgcagctacagttgtattttactgtgacgtacttttgcgcgcgtacgggttcaatgaattacggattttcaacaacttcacacaatcatagctttttttactttttcgcctcattattttctttaaagaaacgatgataaacagagatttatcgtcatgttatttcgttcgtatatatcgtatttgcgttttagctgtataaagtaaaatactatatctaacgtggctttttttatttccccgtctgccctcttatgctcatagaaaacactaatgatcggtttggtatcgtcatagatgcagggtcttcgggttcgagaatccatgtgtttaagtggcaggacacggaatcgcttcttcatgcaacaaaccaggactcacagtccatattacaatcagtacctcatattcatcaagaaaaagactggacttttaagctgaatccaggcttgtcgagttttgaaaaaaaacctcaagatgcgtacaaatctcacatcaagccgttactagattttgctaagaatattatccctgaatcacattggtcgagttgtcccgtttttattcaagcaaccgcgggcatgcgccttttacctcaagacatacaatcttccattttggatggtttgtgtcaggggctcaaacaccctgcagaatttttggttgaggattgctcagcacaaattcaagtcattgatggtgaaaccgaaggtttatatggctggcttggcttaaactatctatatggacactttaatgactataatccagaggtctctgaccattttacatttgggtttatggacatgggcggtgcctctactcagattgcgtttgcaccgcatgattcaggagaaatagctagacatagagatgacatcgccaccatcttcttgaggagtgttaacggagatttgcagaaatgggacgtttttgttagtacgtggttagggtttggtgccaatcaggctagaagaaggtacttggctcagttgatcaatacccttccagaaaacacaaatgattacgaaaatgatgacttctctacaaggaacttgaatgatccatgtatgccgcgaggaagcagcacggattttgaatttaaagataccatatttcacatcgcgggttctgggaattacgaacaatgtacaaaatctatttatccgttacttttaaagaacatgccttgtgatgacgagccgtgcttgtttaatggtgttcatgctcctcgaatagactttgccaatgacaaatttataggtacttctgagtactggtacactgccaacgacgtattcaaacttgggggcgaatacaactttgacaaatttagcaaaagcctaagggagttttgcaattccaattggacgcaaatattagcgaacagtgataaaggcgtgtataattctattccggagaattttttgaaagatgcatgctttaagggcaattgggtccttaatatacttcatgaagggtttgatatgcctcgaatagatgtcgacgcagaaaatgtcaatgacaggcccttatttcaaagtgtggaaaaagtcgaagaacgagagttatcgtggacactaggcagaattttactttatgcctcaggtagcatattggcaggtaatgatgacttcatggtgggtattgcgcccagtgaaagaagaactaagctcactggtaagaaattcatacctggcaagttactggagtctgatcaactacgcaagcaaagttccagcctttctaataaaggatttttgatgtggttcgcaattatttgttgcatattttacttgatctttcataggtcacacataatcagaagacgtttttccggtctgtacaacattaccaaggactttaagacaggcataaggagaaggttgaaatttctaaggagatcagatccattttccagattggaggaaggtgaacttggaacagacgtagatggcttcaaagatgtgtacaggatgaagagtagcagtatgtttgatcttggtaagagttcagccacaatgcaaagggagcacgaaccacaaaggacagcaagtcagtccgctaatctcgctccgtcaaacttacgacctgcgttttctatggctgatttttccaaatttaaggacagtaggctatatgattgaatgtggtggtgtatgtgccataaatagaagcgcatatacttctcacataaatatatgtatatatctagtgaggtgccatagtattgcattaacagtgattcacgtcactctaaacgtcgcttctgttttttttttgaaatttttttctcacagctgctgaaaattttcgagcgaggcgatgagatgagctaattatatcaagagggaattgtactagtaatactttggtacacacaagaacaagcatataggtatacagtcacgactataatatcataaaatgagagtcagaaagcgccaatctagaagaacatctaccaagttgaaggaaggtattaagaagaaggcttctgcccatagaaaaaaggaaaagaagatggctaagaaggacgttacttggagatcaaggtctaagaaagaccctggtattccttctaactttccttataaggctaagatcttagaagaaatagaagccaaaaaaatgaaggacttagaggaaagagagcttgccaaacaacaacgattggaggctaggaaagctgccaaggaacaaggcgttgatgcaatggatgaagacatgatagaagacgatgaaaatggattagcagctttggttgagtctgctcagcaagcagctgctgaatatgagggcacaccctctaatgatgcagatgttcgtgatgatgaattggacgtcattgattataacattgatttctacggtgaagatgtagaaggcgagtcagaacttgaaaaatctaggaaagcttatgacaagattttcaaatccgttattgatgcttctgatgtcatcctatatgttttggatgccagagatccagagagtacaagatcaagaaaggtggaagaagccgtcttacaaagtcagggtaaaaggctgattttaatactgaacaaagttgatttaattcccccacatgtattggaacaatggttaaattacttaaagtctagttttcctacaatcccattaagagcttcttctggtgcagtcaacggaacttctttcaacagaaagctaagccaaaccactactgcaagtgcactgctagagtcgctgaaaacttactctaataacagcaatttgaagagatctattgtagtgggtgttatcggttatccaaatgttggtaaatcatctgttatcaacgctcttttggcgcgccgtggaggtcaatcaaaggcttgcccagtcggtaatgaagcaggtgttactacctctctgagagagatcaaaatcgacaacaagttgaagattctagattctcctggtatatgtttcccaagcgaaaataagaaaagatcgaaagttgaacatgaagctgaattagctcttctaaatgctctaccggcaaaacacattgttgatccgtatccagctgtcttaatgttggtaaagagactagctaaatcagatgaaatgacagagagctttaaaaagctgtatgaaattcctcctattcctgctaatgatgcagatacgtttacaaaacatttcttaattcacgtcgctcgtaaaagaggtagattagggaaaggcggtattccaaatcttgccagtgctggtctttcggtacttaatgactggagggatggtaaaattcttggttgggttttaccaaatacatcggcagctgcatctcaacaagataaacaaaatctaagtactataaacactggcactaaacaagctccaattgcagcaaatgaatccaccattgtatccgagtggtccaaagaatttgatttggatggattatttagctctcttgacaaggccatagatgctagcaaagatcaagatacaatgatggaataaataagtcatatgtaaggctatttttatgtaaggggtgtttcttattttttctttatcatcaaataacattactgtaaattataggtgtgcttttaaactcattactatacatcttattttttttagttttactgcctttttgctctttggacaaagaaatcattaaaaagttccaacttttattatgtttcatatataagatatacaaaatataaaatgcaaaacgaatttcagagatagcatgacttatgaaattggggacagactcaagattggtggatatttttgcaccatcaaattcataggtgttattaagccgtggccttcggtaaaagcttatggggtggaatgggacgatcacagccggggaaaacattctggaacaatagatgacatacactattttgacgttcaaattcctaattcaggatcatttttgaaggagtctaagattaaatctccaggtgtacgcagaattacgttttacgaagcattgtcagaaaagtatggaggctcgagtaataacattaatgacctatctataggtaacaaaagggttgagggtttgggattcgatgaactaaatgcgagaaataagaattataagaagttaagaaaaatagctttgcgagattccgatgtcgctatattgtttcaaaatcaagatgagttaaaccgtgtaatacaaaattgtgtgaacgtcaaggaccttgatttatcgcttaatctattcacgaatatcaactctttatgtgagttcatagaacctttgaagaacttggagagccttaatatatctcaaaataaacttttaagcggttgggacaacttgaaagaatatgacctatcacacatcaaaactttacgtctgtcttcctgtggtttaagttataaacatattggtaagctgctcaaaagcttcaggacactgaaaatgttggatttaagctataacaacttgaccagtgcgggaatccaaaattttgagaatgaaataccgtgtactttggaggaactgaatattagcggaaataatcttatatcgtttccattgtttccaaaaaatttgacattgaaaggtttaaatgtctccaataatcaaatttctagagcaccaagtattgctatttattctgttgaatccttggatataacagataacaaatttaaggaaagaagtttgatagatgatttgaataagacatttccctctttgaaaaatatccatctgagtggcaacgaattcaactacaacggaaattatattaacgtcgaagaacaggctactttttatgaagtactggctaggtttgatcgtgtgatggtattgaatggatcaatatgtgatgtaaaaacaagaagagaggctgagatgttttttgtttccaaggtaatgaataacgaattgagctatgacaccaatctgccgcgttggtcaagcctcataaagtcgtatgaaatcgatatgagtaagctaagtttcaacaatgaaagagaaacacggcaatctcttgtcttaaaaataaagataagagctggcaagaagccgagtagtgatttagattattgggtccttcccagttttacagtaaggtacgttaagagtgtaatatgtcgaaagctaaactttgacatactgaatgttaagttatttcatgaaaattctgaagggatgataaacgaaataaagtataattttcgccccatttcagattttaatgttgtgaacggagatattattcatgtttcgtctccagtaaataacaagagcattcagaaggttaacagcccatcgtaatcacagtatatagttaatcttggctagttgcatatttaaaaatcaggaaacagccttttagattgtaagcggatgttattctaattttttcttagtttctttattttattatgtagcagatggatagtaatatagtgttgacggctccgtttgttactcaacgctgaagttccataaggggtcgcccaaatggtgaatcaattctatggaatgacctttgttcactgatttaatttcttcagtacccatcatcaattcaccaatagccaatgcattctctttattttcggcattgatgactacaatcgtacctttctcgtaaccaggagcaggtggtaagtcggcacccgcagaagttaggccagggcacatgatattagcacctgagagaacgaatttaatagcacctctatcaacctgaacagtgggataagcctctggaaatttgtgtactaatttcaggcttggaatcagttcatcgaatttttgaaaaaaaagaacttcaccatcgacggaatacaattggatcttatcttcacatttaatcaactcgatttgactcttcttaggaattaattcatcaataacatcttctattttggggtactgcttgaccaatttggcctttaacgttctttgaattgaagatttgacctttgaacgtgaatggacatcttctcttgtgaatctatcgatgatgatgttagtaattgcttactgagtcaaaagtgtacactaacccctggtaaaaccagtgaattacgcaatattcattctcatgttagacatacttcttaaacatttcctctctgctgttttagtttaccgtctttgtcttttatatggttttacataaggttatagcaaaatcaagttttttcacacaataatttttcagataattaaatttttcgtcatttttacacctacaaatacaaagcataagagtaaggtaactatgaatttagtggaaaatgaccataatgataattatcaatagataaaattatggtttttgaggtgaagttgaggtctcgtttatagacggcactgtcaggtaattggtcaactctcctatacaaagtttactgtatcgggtgaaaagaaagacacacaagaaggagaacactcatgcctaccattttagttgccatttctgtattacttacaattccagcttctataacgtgaactcacattagagaattcggtgaaaaagaaaagaaaaatatggttgggccctcaattgaatgtttcagtccggtatccctaacctattttttgatattacttccaaagaaaaataaacagtccctttgaaagaatgaatatcggtaatgaaaaaaggtattccaaaaattccctacatagtcttgaagtattcaaaagcgaacaccgaattgaccatgaggagacggtctggtttataattaaatttcaaccagcaaaaacacaatctcggacgaatcctcactgatatgcgtatttcccgtgcataaggatggagtattaaggaaggaagtgaaagaaaagaaaatgcattaaacgtaagtaacaatagtaattggacaatgaagctaactaatattctgttccttttatattcagaaaaaaaaattcgaaaactaatatatcattttacacgatatttgaaattgaaatttatcaaaatatttacttaattagtctaaatatgtaatatgaagcgacaatgcagaggttacttaggcattcttgtattcctcgaacgcacttatgatatcgttcttcgtgaagcgtatgtttgtccctctatagtgtttatcaattacagtgtatagtttcaagtatagtgagacggtttgaccttgaatgcacgaccacaacttatcgcataggacgttgtttatggcattttcttggtggtaaccgaagtcatttaccatatgagtgtgcagcctttttactagagtttcaatttcatgggaagtgtatgctaaaagaatgttctctaggttctgcctgctatatgcggcccatcttgaaggattggtcatgttcacattgttggtattttcaatgatgttgctcacaccataaacaaaggctgttagtttaggcatagtatcgcggagtagaaaggaagcataagattctttttccacatcgaaaactttcttaacgttttgcaatgacgtatcaaatataccatccttattgaagtttaacatggaaagcatttcagttagccagttactgttcactaggagagaaatagtttccatatagtcattatttaaagcagcagtatctgaaaggtttggattaatgcttgaattaacttctttgtgagttatcgatcgtgtggcagctatgcttagcttcctgaagctcgaattcattaattcgatggactcgtagccttcatcggtatctttaatatccatagacctcttagcaaattggaacaaatcttctgaattcttcaagcctactggtaaatcaagtatacctggaagaatttctccattggtggttgcgttagaaattctttcgaagtgcaaaacctgctcttctacattatcagaccacacttgttttatttgtgtgtacattctagtcactgcagacaataaaaattcatggttggatgattctaagcttttaatttcattctccaagtaaaaagttaaggctggggctaccgttggttcggctttcactaattctacaaaatatgaggacagcctagtgacaataggttggaatattcttgagaccaactgggtttcaataacggctgcttctctatcagattgcattactttcacagtatctaataatattggaggagcatctggatcattgaaatgtttaatgtattcttcgaaattatgctttgaagatatatgaaagaacacttcgacaaaattttgataaacaatacattcttgcctcatggtttgaaggcactcggtaagaagagaaaaactattcttgaaaaccgggttgatatcatttgtttttctctcttttctaaatgtgtcccattcatttagtaactggcttaagctcagctcattcattttttcatcatttgtgtcaatgccttgtaattgtgatattttcttagtccataactccatgtatactggttgaatactgacgttccaattttccacaattgcttgatacgatttttgtgaaatttctttacagaacagtattaaaggagaaaatatcaataaagtcgtcaaaattctaatcatttgatcgtgtgagatatcttgtccacgtatatttgagaatttcttctgcatttcctccacaattctgttaagaaatatcttggtaactttctcataaaactgtagcctctgctttagtccggaaatttctcttagattatattctacttcatttccatcgctgcctattgcttgaaatgcttttaataataaattcaattggttttccatccatggcaagttcttctctcttattggacattctaataactgatttagggaaatttcatcaagagatacagttttcaaaagttcatcaagtgtgttccatagaagtttcttgttagcactttcaacttgtaatccgttatcttggctctctacgttttcgatatcattagaaaaattgctcatttccatcaagaataaagagagagtggggattatgcgatgacattcgtcattgaccttgtcttcgtaggggcggatattaggcccaattttttgcaaagataataaattttggttgaataagtattccgtttccgccaatcttaagtcaatcctttcaatcatactatcagcatcgtcttcaatggaccaattgatatctgttaatatttctaataaaacctcatcgtcaatattttccatcgtttttatctcctctttagattcaatcagcgcttcagattcgttattctcttccggaaggattaatttctgcgaaacggcaggtgcttcttcttgaataattgacacttcatggtacacgtgaggagcttcaccttcaaaattattgctatacctaacctcatctcccttctcgaacgaaagatcgttcttctcatcttggtcctctcctgataagttagatgtattcaaacctgctatctcgtcactcaaactgatcgagtcattcaaatcgcttccaccgagtgactcaactttggcaatatttagtggtttttttaattggtcatgagctctagctgtacttctctcgggcacgtaagtaccattttgcatagtaggggtggtttctgtttcttccgccaaaactgcgtttaagtcctccaaaaggttatcaaccttaccatttatttcttgagtataactttcattgtctactttgtttcttttacttttttcttcctcctcctttttagcaagcgcttcttgctcttctttttttaatctctcagctgtttcttgttctctttgttttctctgtatttccaatagttctctctctttttttaggcgttgctcttcttcgaattgccgttgacgtttcaactccatttgctttttagcctccagttccatttgacgttttcgttcctcttcttcgagttgtcgttggtgttccaattccatttgccttttcctctcctcctgctttattcttctttcctcttctaatcttttcatctcattttccttttgtaactgaagtcttttttgctcttctaatcgtctcagttcagcctcttcttgttgctgttgttgctctaactcgtatcttttattcacttcattcaatgtcgaattggaagaatagggggccttatttagagatttcattcctgcatgatattccacgcttgcaggcgttgacactggattaacgctttctgtttcagaccttcttgtcctctcagtaggtgctgaaaaggggacagagcccaccgattgggtagtgtttgtcgtgaaattacttgtaggtgactttattggagatacggaaccggggcgatttgtgatgactgctctttgataactcctctcgtcaagataaaaaagggataaatcccaattgaccaattcagggacatgaccttcgaatgtttgaatgtatagagtaattagagatttaatgaaaacagttctttccttcgcagaattcgtttcccagtagtattttttactcatggtaagaatgaagccttcagatatctccaggtccttctctactcttactagttcggtcaactgccaagttctaccaatttgaaaagagccgtctgagttttctcttgctttatgaatttgtattagcttggcattgttgggcttggcactcaaaataaggagtcttttctttttgttctccaattttgaatctggaggaggtcttgaactagggaattttgaatcttctataatccggacatgtgtaatataattattcggcggttcacctgtcttatggtcgggtctggaaaagcagcaattaattatggctttcctatccctttcatattgttcggctaaaaaattcgaagtttgagaggaatttgaagctctcgacacgtttctcttatgcgaataatttccaccagaaacaggtggtgcggaagagggtactgcaccttgactgacgtttctagaatggtgagcactgctaccggatattgttctcttgtggaaaaacgatgtgttttcatcgtgtgatgtctcacgactgtgagacttccttttaaaaggagacttcgaggacctcataatatagaataaattgcgtagccttgttacctagctggagatatctggcaccgactcagtctttatgaccgctttttcttcataagctatgatactgttattgctataagtgttcaccaagttagtatttgcccattaataccgggtgacatagtcccacaagcgtggttctcaaaaagcaacgaaaaattttctgacttggcaaggtgagacttaggctgataagtaagtactttttagtttttagtgtacaataccccctaaggaacccaggttttaatactattatctttataatgtctctcgactttaacactttggcccaaaacttcacccagttttactataatcaatttgataccgatagaagccaattgggtaacttgtacagaaatgaatctatgctaacattcgagactagtcaattgcaaggtgcaaaggacattgttgagaaattagtatctttgccatttcaaaaggtccaacatcgtatcactactttggatgcgcaacctgcttccccaaatggcgatgtcttagtcatgatcactggtgatctgttgattgacgaagaacaaaatccacagcgtttctctcaagtgttccatttgattcctgatggaaactcttactacgtgtttaacgatatcttccgtttgaattactctgcttaaggattttttaagtcaccacagaaacatgtattttcattttcgaatattgtttagcataattgaagatgcttagctaacgatgtataaggcgatagcgataaagaagatatatatatatatatatgtatgaagatagcgtttttaaatgtatttctttaatactgatcttcgatcattttgagcttgtttggcgggaataccattcttaatatcttcagagacaagtaaatccacttcaattgacttttcgatataggtaactaattttgaaatgtcagtctcttgaacaggaatgcgtactattccattattgtcacctgcaatataatcaccaggacatattgtttgggttacgccatcactcgttaagattttcaactgtacgttagtgcctacggctttaacgacagcctttggagcgcaagatccaacaccgtaagcaaaaacgggatggtttaaagtccggtgttcatccacatctcttatgcgtccaaagactactgtcccattcgatttcaaatattgtgctctggtactcatcagccccccgtacatcgcttgcgtaattttaataaatgggtggaactgactttgcaaatggggctccagtgcgaggacgagtattgagttgggagggacagagtctatatagttcacggcaggtcttggatcatcaatgggtgcaaacagtactgtgtatgcagtgcctactatggagctattttgcggtggagaaattgctgttagattagggaaataaccacccgttggaatgttataaacattcaacaatccgtccgaaatatcacaggttgagaacctctgtaacttttgaagatctgacattgcggacggcggtttctacttatactgttaatttttttaaaagttggtttagtttatggaaagccatacagttcaagttttttcgcgctaagtaaggtgatcacttttttttatcgttcttatcacttccagctgtaatacatcatagagattaatgaatgagcaacgtttgactcacatacagacctaagtggcggaaattattattggcaaaatagctgggcttgcagttttcctgattatttgggtaagctgatggtattctccaaacgcggtgggcaagatctcagattatctgctccttatcgactgctttttatttctataaatgagcttgtatacacatgtatagtttgtatttggattatttatacttttacggattatgttcgtattgtttgtatttcattccctaattttcctttacagatataatttcatgattaaatttcaaggcaaaatataaaattattcagaaatagcttcatcacacagtgtctagcgaaaatatttgttaaaatgcttaacccaaagtgtcattctcgacagtgaacctttcctaaaaacttacaattgttattacaaagttcttcgggggataacagtcatggagttacagcaatgataccttatgcggctaagttttctttatttgcacataaagggtgccttcaacattactagactgcgtggtgttgttcaattcaaactggagacatagactacgaaaatcttttagtcaaatttacaagggcgagtagcttttaattgtgccttcatgtgccaagtaaattgcgtacaaaaagtgtcaagagattttctcattccctacatttgccagttctataggcaccttcttgcgcatatacatatctacaaatatcccggcttatttccagtattactatgttttactcttaattcaaataagcactgctattattacttttgatcacgtcaaaagatacaaaagacaatctacaagtttatggccttgcattgtttataatttatgtgctatctgagcatacccgccttttctctattgttattcgagagaagactaaaaatatctgctgcaagaacaaaaatgggaactgcttgtctcttaaaattatcaatccacaatggaaatagactttttttacacagcaacggtttttgaatgctatgaaacggtcattatcagctaacacgctcaacactttactccatcttcttaaagggtgtaaacagaacgataaatgatttccataaatagtaaggcccagccgacagcctgcagcgcaaaagtgaaccgtttccatctaacttggataatctgcattgttcccaacgaatgacagaatccatcgccagatctaataaggttcaattttctctatacgacggctataaaaggaagttttccgagcgcgcttcgaagcagaatagggaggaccccagacccgttttagtgcctgtccctttttagtacgtgtttccgtttccgtgcctggctagatccatctttcttcgcgcgtttattttcagcaccatgttttaggtttttacagcatcgtttaaggaacccaacaatacaatagcgggaagaatgcactttctcgttccataaagggtctctttcacctatacggttggtacagatttccagtgtatgccagtcagccacggcattacgtcgtttgcttctattttcttcgttttgaactgcgtttgtatgcaactgtcccttgacagagaaaaaagtgaagcaaaatgacagacaaagaaatcttttgtataaaaggtcggttgaatcttgttgttagcttgaaatcagcttgcttttctcctctaaattacataaaaaaccaagaaaatatcagactttttcattcgctttcaacaagtactacaataattaaaaatggcttacactaagatcgctttattcgctgctattgctgctttggcttccgctcaaacccaagatcaaattaacgaattgaacgttattttgaacgatgtcaaatctcacttgcaagagtacattagcttagcttctgattcttcctctggattttccttaagcagtatgccagctggtgttttggatatcggtatggctttagcttccgccactgacgactcctacactactttgtactctgaggttgactttgctggtgttagcaagatgttgaccatggttccatggtactcctctagattggaaccagctttgaagtctttgaatggtgatgcttcttcttctgctgccccaagctcttctgctgctccaacttcttctgctgccccaagctcatctgctgccccaacttcttctgctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccaagctcttctgaagctaagtcttcttctgctgctccaagctccactgaagctaagataacttctgctgctccaagctccactggtgccaagacctctgccatctctcaaattaccgatggtcaaatccaagctaccaaggctgtttctgagcaaactgaaaacggtgctgctaaggcctttgttggtatgggtgctggtgttgtcgcagctgccgctatgttgttataagttattggtttttaataataactacgtaaaaaataaccatagtcatacccttttttattaactactttcggtcctttcttctgctttacaattaatgtaaatatgtttcggttctttaattgcatatataacaagattaatttttcttttttttaattcattttgtcttctatagtttttcctgtgccatattttaaatgttccagcggtgttggcactactgtctgttggatacttgtataagatatcaatttattaacttattgcaagaaattattttgtgcagtgtgaagacttaaagtgtattgaaagaccattgaggaagacctgaacattaaccgaattcaacgaaggctgaaatgctaggattgataacgtaacagaactaattagaatgtgtagacatgacacatgctgattgaaacatcatgtcaaatcatcatcttcctttgatgcttttttagcagcttcgaaaacttaccttcaacaacaacgattttacataacactactggcgttaaagaaatggggtggcaaagatagaaagaaaaattctactggagaatgtatgaattttgaggtaatttttgggatgccattgctgttagagatcatagtattaggtgcacaaaatgaacaaggagttctccttaaggacatacgaatccacaaaagggtatggaaatttctacatagtattgtgattatcgtgtagaaataccgattacattttgaggattcctatatcccggaggaaaaacttctggtattctgtatacataatattgtagcctttaccaacaatggaatccgaacaattatctcaaaattcacccaattatcacttctatcggctggtgttcgtactactactgttggaatgaaactttaaaatatcattcattcggtaatattcctctaaacaattctttttctcaacctagcaaagtaacccacacttaaacttattacgattgttcctcattgctaattcatattccagcatctttgatatatcatattttgtctaaatatcgtctaccatgatgatattcatgaagaataaggtttttcaacctactttgatccgatatagtgtaacggctatcacatcacgctttcaccgtggagaccggggttcgactccccgtatcggagtacttttttgatggctacaatcataatttgacatacctcatatgaatatgatgtggtagtaaattaaataggctgaatcctgatagtttgagcctgggttctgactatccgagaagcgcacagcaacataacaccaccttcttttagtcttttagcgaaaaagtaggaaggctctgcactccatcgtttttaccattcctacacgttataaggactcagacaggcggcgtagttaaaataaattaacaccgagtcttgaacatgtaatttctttaggttcattgaagagataattataactttcctgcccacaagtcctctgatttacattcgaacgaggctcattaacgtagtgaaaactgttcataacgcaatctcttatgaaaaccatgcggtgaattccttttgacaggttctctatgatactatcgacgcctctcaaatatcaatgcgtattactgcatcagcaaagctccgtcatctacatctaggccggggcatctttcgcagcgaaatctttacggtggcaaaaaataaagaaaagtgaatattgaacaccaattacaagaaaagggagcacctgtcaatcgaataaaaaagaacaaacttcgggcacgtcttttaaataggttcatatacaatactaagaaagatatattaagaaatggatattattctgggcatccgtgtacaggattctgtcattctagcgtcttctaaggcagtcacaagaggtatttctgttttaaaagattctgatgataaaacgagacaattatcgccacatacattgatgagttttgccggtgaagctggtgacaccgttcaattcgccgagtacattcaagccaatatccaattatactccattagagaagattatgagctctctccacaagcagtatctagttttgttaggcaagaattagccaagtcaattaggtcgagaagaccataccaagtcaacgtattgattggaggctatgacaaaaagaagaacaaaccggaactatatcaaattgactacttgggtactaaagtcgaattaccctatggtgctcatggttactcggggttttacacattctctttactagatcatcattatagacctgatatgactactgaggagggtttagatttattaaaactatgtgtacaagagcttgaaaaaagaatgccaatggacttcaagggcgtcattgttaaaatcgtggataaagatggcataagacaagtagatgacttccaggcacagtgaaagatattcagtgtaatcacacggaaaaggtgattgctaatgatatactaaagtaattatcttcctcgttcataaaattaaataaagttattatagttttttcatccgttataatagcaaatgtatcagaaataagacaatttctcattttttgttggcagagtgagatatcatctgatctattgcaaatgaatcccaatcaatgctgataccgcttcgttataaccaattcgaaaagttgtaattatgttacccgcatgagaatattttgaagaagcaatgtagggctacgatagtacttttgagatggtttattacttgttcaaatgctgtcatctcatgttgttaatgcgctatatttcgcactacgaagctaattttcaacataggtaacacaaagatattagagatgtctgatatatcgaaactcataggagctattgtgggatctgatgaccccgttatcattgaatttgtgctgaatatcataaataaatccggcaatttacaagagtttatacgaaatattcaaaaattggatgccggtatatcctacgaagacagtattaagatgtataatgcatttttaggaaagcaggaagaagaaaaggtacgaaataaagttaaaagttcaccgttaagtcaaaaaattaatcaggtactgaaagatgacgttaatttggacgaccctgttgtgactgaattcgtcctgagcattttgaataaatctaaatcaataactgagttccaggaacaactgaacttgatgcaaagcggactcgataatgaaacaattttcaagatatatcaaattgcatcaccaccagtaatgaaagaagaagtctcagttcttccaagcaccaagataccagcaaagatagaagcaaagattgaagaagaggtacaaaaaatagaaagtttagaccccagccctgtccttcacaaagtttatgaaggtaaagtgagaaacataactacttttgggtgtttcgtccaaatttttgggacgcgaatgaagaattgtgatggcttagttcatatttcagaaatgtcagaccaaagaacattagatccacatgatgtggtgagacaaggccaacatatctttgtcgaagtgataaaaatacaaaataatggaaaaatatcgctctccatgaaaaatattgatcaacatagtggagaaatccggaaaagaaatactgaaagtgtcgaagatagaggtaggtccaacgatgctcatacaagcagaaatatgaaaaacaaaattaaaaggcgtgctttgacttcaccagaaagatgggaaattcgccaactaattgccagcggtgctgcttccatcgatgactatcctgaattgaaggatgaaatacccataaatacttcctatttgaccgcgaaaagagatgacggcagtatcgttaacggtaatacagagaaagtggactcaaaattggaagaacaacaacgagacgagacggatgaaattgatgtcgagctgaatacagatgatgggcccaaatttttaaaggatcagcaagtcaagggggccaagaaatatgaaatgcctaaaattacaaaagtcccgagaggatttatgaatcgttcagcaatcaacggctctaatgcaatacgagatcatagagaagaaaagttaaggaaaaaaagagagattgaacaacagattaggaaacaacagtcgtttgatgatcctacgaaaaacaaaaaagattccaggaacgaaattcaaatgttgaaaaaccagctgattgttactgaatgggaaaaaaatagaatgaatgaatctatctcgtatggcaaaagaacttccttaccaatcagtgcacagcgtcaaactttgcctgtatacgcgatgaggtctgaattgatacaggctgtgcgtgacaatcaatttctggtcattgttggtgagacaggttcgggtaaaaccactcaaattactcagtatttagatgaagaagggtttagtaactatgggatgatcggatgtacccaacctcgtagggttgccgctgtatccgttgctaaaagagtggctgaagaagttggctgcaaagttggccatgacgttggctataccattagatttgaagatgttactggcccagataccagaataaaatatatgactgatggtatgttacagagagaggcgttgttagatcccgagatgtcaaaatattcagttatcatgttagatgaagctcacgaaagaactgtggcaactgatgttttatttgcgttgttaaagaaagcggctattaaaaggccagaattaaaagtaatagttacatcggctactttgaactctgctaaattttctgagtactttttaaattgtccgattatcaatatacctggtaaaacttttcccgtggaagtactctactcacagacgccccaaatggattacatagaggcagctttggattgtgtaatagacatccatattaatgaaggcccaggcgatattttagtctttttgactggacaggaagaaatagactcatgctgtgaaattttatatgatagggtgaaaactttaggtgacagcatcggcgaattactgattttgcccgtttattctgctttgccaagtgaaatccaatcgaaaatttttgaacccactccaaagggcagtcgaaaagtcgtatttgccacaaatattgcggaaacttcaatcactattgatggaatttattatgtcgtggaccctggatttgcaaaaatcaacatttataatgcaagagcaggtatcgagcagttgatagtgtctccaatctctcaggcacaggcaaatcaaagaaaaggtagagctggaagaacaggccctggaaaatgctatcgactttatacagaatccgcattttacaatgaaatgttagaaaacacggttccagaaattcaaaggcagaatctttctcatactattttgatgctaaaggccatgggaattaatgatttattgaaatttgacttcatggatccccctcccaaaaatttaatgcttaacgcactgacagaattataccacctgcagtcactagatgacgagggaaaactaacaaatttaggtaaagagatgtccttatttccaatggatcccactctatcacgctctttattgtcatctgttgataatcagtgctcggatgaaattgttactataatctcaatgttgtcagtacagaacgttttttatcgtccaaaagataggcaattggaagcagatagcaagaaggcaaagtttcatcatccatacggtgaccatttaacattattgaacgtttatactagatggcagcaggcaaattactcggagcagtattgcaaaacaaactttctgcattttagacatttgaaaagagcaagagatgttaaaagccaaattagcatgatatttaaaaagataggcttaaagttaataagctgtcatagtgatcctgatttaattcgtaaaactttcgtgtcagggttcttcatgaacgctgctaagcgagactcacaggtaggttataaaaccatcaatggtggtacagaggttggaatacatccctcgagttcattgtacggaaaagagtatgaatacgtaatgtatcatagtatcgtattaactagccgggaatacatgtcgcaggtaacatccattgagccccaatggcttctcgaagtagcgcctcatttttataaagctggagatgctgaaagccagtctaggaagaaagcgaaaatcattcctttgcataacaagtttgccaaggatcaaaattcatggagactaagctcaataaggcagtcaagggaaagggcattaggtatcaagaggtaacattgttagctttttatgcattataattatcgagttttatagacctatatttaattttttaacaactttatctctcttgagaatttttacatgaaaaaaatcacagagtaacgctaacctttctttaattgaaagctgccattgctcgtttagttacaaaacgcctttgaacttgccttcgacactttgttgcttcggagtcgcggagtattcaaaaaaagaaatagtataatagagagaacaatagagatattcgcgaagaacaccaattcaaacatatcgagtaaagtgcaattgagaacgccaaaaagagcttgtataatgttattaccattaacaaagctaaaaccgagagcaaaagttgctgttgtagggggtggcgtttctggactatgttttacttattttttaagcaagttgagaccggatgttgaaatcacactgttcgaatcgcagaacagaactgggggttggatatattcttgtaacacaagagatatgagtgggaacccaattatgttggagaagggacccagaacattgaggggcgtatcagacgggaccgttctgattatggatacccttaaagacttgggcaaggaagcagttattcaaagcattgataaaggttgcattgcagacaaaaagtttctactagaccccagtgataaactcgtgcaggttcctaattcgatatctacaacagtaaaatttctgctgaatccgttgggaaaaggactcatcacgggtatgatgggagaatggttcagaaaaaaatctccacatcctggccaagacgaaagtgtcgaatccatttgtgacagaaggtttgggaataactacatatcaaacaatatgatcagtgccttactaagaggtatctatggggatgacgtttccctattaagtgccaagagaacgtttaagaaaatatactacaatgaactaaagcacggatctaacacacaagctatgattgataatatgcgcggaaagtcaagaagtaaaaaaactgagaacctgcaccaatctttaactggctgccttaacgactactcaaatgcgtttggaaaagacaggtcaaagttattagacttatccaacacgctaaagaaatatcccatgttgggtcttgctgggggactagaaacgtttcccaagatagtcagaaatgctttgaacgaatttaaaaacgtcaaaatagttactgggaacccggttacgcaaataatgaaacgccctgctaacgaaacgacaatcggattgaaagcgaaatctggcgaccaatacgaaacatttgaccatttaagacttacgataacacctcccaaaatcgctaaattgctaccgaaggatcaaaattcattatccaagttattagatgagatacaatcaaacacaataattttagttaattattatttgccaaacaaagatgtaatagatgccgatctacaaggctttggatacttggttcccaaatccaataagaatccagggaaattgcttggtgtaattttcgattctgttatcgaaaggaatttcaaaccactttttgacaaactctccacaaacccaaacgcccccaacgaatatacaaaagtgactgcgatgataggaggttgtatgctgaatgaacacggtgttcctgtagtgccatccagggaggtaaccattagtgcagtcaaagatgcgctgaacaaccacctcggcatcagtaacaaggatctggaagctggtcagtgggagttcactatcgccgatagatgtctgccaagatttcatgtaggttatgacgcatggcaagaaagagctgaaaggaagttgcaagaatcttacggccaaacagtttctgtggggggaatgggattttctagaagtcccggtgtccctgacgttattgtagacggctttaacgacgccttacagctaagcaaataagtacgtatatatatggttagctttacgcaaactacttcttttgacaatcgaggcagttatcagctaataagcaaaagtagttagtatcaaaagacacaatttatttatattaaccaaatttttcagaacatcctccggaccgtcagtctttaacgccgagccgccgatgatgggttggagtcaaaacgagggaactcaatattaattgcggagttgagcgatgatgggttggaactatataaagcatcggaaacgcatggctaagggaagtggaagaatgcaggttacaaaaaacggataagaacaaacttgtttcgaaatatggccgctccagattatgcacttaccgatttaattgaatcggatcctcgtttcgaaagtttgaagacaagattagccggttacaccaaaggctctgatgaatatattgaagagctatactctcaattaccactgaccagctaccccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaatgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagcgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatgcaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttgaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcatcgatgggctacaaggatttgaaaaattgcacaacatcaaagtcggacttgagcctttgactctcgaggatgatgttgtgacgccaacttttaaaataaagcgtgccaaagcatcaaaattcttcaaagatacattagaccaactatacgccgaaggttcactagtcaagacagaaaagctttaggtacttatgacgattgggaacacattcaaactagaagaaactttgatgtaggatatccctatgcacatccatacggtatacatagtgaacgctcactgtgtataatggactaacagtagttataaacctgctttcgttactacagcacacaagactattgtactttgttaaagaactataagattaaagacatacataattccaactatttataccattaaatattcttcttaagctttttttcgcggcttcctataatatatgaggatcaattagtgaaagcaatgctctctattttggaaccacagtgtagatactgcactttcataaagcgctagatatagctggccaatctagcggagtacatgggtcacagttactattctcgtaacttgacttggtgcactacgggtcaagatgattgaaaacggctcccacaacttcaactgaggtctgtttcagatggaggtacagtgttttccatgtagtgagtcctgatatcggggcgtaatcacctaactcagcaaaggtaaccctttctcatctgacggagataaagtgatagtaatcggggatgcggcaacagagattgaagttaatttgaccattgaatagttgcttatatatgatagacttagctaaaagaaaataatgaaggcgtaccccatatcgctgatcagagaaatccatatagatagaatttctgactccgctaaaactgcatgagcgactgactgaagctccactcattcaaaaattatccctcttcacttcccgtattcatacttgttcccactatggacatgctctctttgaaaaatgtagtctcacccacagaaaagaaaagatcatttggaaataagataccccggaaaacccgcttgaattattccagtgtttctatctaaagaaaaatcacgcaaccagaagcagatttcgtctgggttcgttcaacaactctttgcttaagatttatttagcatatgctaaatcgccataaggagcaaaacccagggcttctaacgatttctaataaagaagaaacggaagttttcatgtgttggcaacaacattacagggattttttcagactttcatgttaccggtcaacctgctgatgcatacatacaggtataaagaacactttaaagagaagtcaaagacatctgagaggcatcttcttacctgaaagagacgccttgtatcttctataggtcaactagagtaggcgctccggaaacctgaatgaacttaaagaccattctcaactccactattaattaaacttagtacgctcgagtttaccatgtgaaccgaaggcatgtaaaaatgtaggctattcttgtgcttatgttcttcctaacgcggctacgcgtttgaagaagttagtagcaaaatggcgaagaaaacaaacacttgaaacaagtcaaaaaaaattgaaggcagactcaaaagcaaggataatattccaccaaatcagggacgaagcaatgagtgcgggtatcggagaatcacgtacagagttgcttacatggttgaatggcctccttaacttgaattacaaaaaaattgaggaatgtgggacgggagcagcatattgtcaaataatggattcaatttatggagacttgccgatgaacagggtaaagttcaatgccacggccgaatatgagtttcaaaccaactataaaattttacagagttgctttagcagacatggaattgagaaaacagtgtacgttgataagttaatcagatgtaaatttcaagataatttagagttcttgcagtggttaaagaaacattggattcgacataaagatgaaagcgtgtatgatccagatgcaaggcgcaagtatcgtcccattataacgaataatagtgcaaccaaaccccgtacagtatccaaccctaccactgcaaagaggtcatcaagcacaggcaccgggagtgccatgtcaggaggattagcaacaagacattcttcattgggaataaacggtagcagaaaaaccagtgttacccaaggtcagttggtagcgatacaagcggaattaactaaatcgcaggaaacgatcggttcattgaatgaagagatagaacaatacaaaggaacagtaagtactttagagattgaaagagaattttacttcaacaaactacgcgacatagaaatcctggtccataccactcaagatttaataaatgaaggtgtttataaatttaatgatgagaccatcaccggccatggtaatggaaatgggggagcattattacggttcgtcaagaaggtggaaagtattttatatgctaccgcagaaggatttgaaatgaatgatggtgaggatgaattgaatgataaaaatctgggtgaacatggaactgtgccgaatcagggcggctatgcgaacagcaatggcgaggtcaatggtaacgaaggtagtaaccatgatgtgataatgcagaacgacgaaggtgaggttggcgtgagcaacaacttgatcatcgacgaggaaactttttaagttgagaactaaaaagcagtattgttttcgaatatgtattatttttttttattttttttattactcgttatcaatatatatatatacatgtatattattactaaaagaatgagaaaataagataggatcctggaagggggatcaggtaaagatataaagtgagatgaagaagccaccgttttatttcccctttaatttgttgctgcaggnnnnnnnnnnnnnnnnnnnnnnnnnnnnnnnnnnnnnnnnnnnnaggcggttcggtattgctctttggatccaaatatttttcaaaagcctcgttcctttccttgaatggccttggacccaataatctaatcatgtcttctctagtaattgcttccttacgtagcaattcttttgcgacgagatcgactttgtccaaatttttggttagcaattctgtacaagctcggtgtgcatcatctactatagatttaacttctaaatcaatggttcttgccgttttattactgaagggtttgttaactttgaagtttccatcattctgatcaaacgacaggtagccaatcttgggtgacattcctagggatgtaaccatggcatttgccatctgtgtaacctttttgaaatcatcatgagcaccgctagtcaccgatggaaaatgtagctcctcagaaacacggccaccaagagccatgatcattctatgtctgaattgctcctcagatatcaaatattgatccggtggtaggtactgggcatagcctaaagcaccttgtccacgcgggatgatgcttactttcagaagtgggtccgcatattttagaaaccaaccacaaacggcatgtcctgcctcatgataggccactgaccttttttcttccttagaaaggactcttgttttcttctctagtcccgcaatgactctttcaatggcttgctcaaagtgatggatagtgatatatgggtcattatgtctggcagcgattaatgcagcctcattacaagcattagcgatatctgcaccagtaaaacctggagtaagcgtagccaatttcccagaaagattattcatatcatctgtaagaaggggatctagattcagtcttttcaagtgaaccaggtatatttgctgcctaccattgacatcaggagaatcaatttggatatgtctatcgaaccttcccggtctcatcaaagcattatccaacacatcgggcctatttgtacccgcaaggactacgacttggtcggaagtagtgaatccgtccatttccaccaataattgattcagcgtagcttctctttcatcgttagcgccaccgagagcgccgcctttgcctctttctttaccgatagcgtcaatttcatctataaagataatcgagggggccatagaccttgcttgagtaaacaagtctcttacacgtgaagcacccaccccaacgaacatttcgacgaactcagaacctgatactgacaagaagggcacgttcgcctcacctgcggtggccttggccaagagagtcttaccggtacctgggggtccagaaagaatagcgcctcgtggaatcttggcacccaatttagtgtacttacctgggttcttcaaaaagtgaacaaattccatgatttcctgtttagcttcatcacaaccggcaacatttttaaatgaaattttaatgtctgtttccttattgaagagctttgctctggattttccaacattaaacatgccgccgaggcctccaccaccaccaccattggcatttggtggtgaactatttatttttctggttatgaagtaaaggccaccaagcagaatgatggtgggcaggaaggggaacaaaaatgtgaagggagaagatctctcaatgtatttgatggggatacgatcccgaggaggaatgttcaagaggtcctggatctggtccatctgttcctcaaaaatatctactgaaccaatggtgaacgatacaacttgctttgtattgactaattcggcctctacgagaaacttattaacgacgtaaatcttggacacaagacccttctccaggtattttgttttgaaatcctggaaagtcaagacgcggttagagtcgtctcctgagttgttactggaaggtgtgagcaaagtaaatataattgtgaatccgatggtcaaaaacatcgtattagcaaattccttagatctgaagtattctgataatgaaccaaactcatttcttttgtctttgccatcttctttattgctattattatctttattaccattgttcttgccctcaccctctttgtttggcctattttcatttaaccttgtccatgagatatggaaggaacgtatttgggtagaacggtgtattgtgtttctggttgccagaccagataacgtctgcaaacgctggtgaactggcatgcgcgagcgaagcactggcttcactgttgatatgcggctagctttaccaaatgagagtgatgtcaatgagcgtggcgcaccccttgcatatcgttgccacatcatcatcacttagtatattataaaataagtggatgatgcctttatttgaagactgcgttaatctcctttaatatagaatgggtccttgtaaaagttatgtatagacagtaagaaccaatttattcctcatctaaatcataggcccagaataaactgaacagatgcgtataaaggcgttataaagatgccagaagcatatcgcgggccacgactaaaaatgccgcgaggtcgccctggacggtaagcacgtgctcaagtgttgcccgactcttggggtccagcgccgggtgagagtttccgatcacgtggtctccgtgcatcgcgacttcgatccagcagcgtgaatcatcgccgaatacgaaacgtacgtcatgcacatcgctggctccgggtagtacacgaagctgcaacagccgttcgtacagtgcgacctctgcggcatcgttacccgactgcgcagcccaacgtgcgcgtaattggacacactctttaccacgctgttgcagcagcgagtccagctcgcgcgattgggctgctaaggtcgactgccgtctagataactcagattcacgctcgtgatagcttctccactgctctctggtggtatttgtagcttgttgggccgcatgtatttgttgctgcagagcggtgcgctgggtggcaagccgttgcagttcatctatgagatgttggtgttggttatgtaattgacgcatttccgcttggaactgttgcagctgttggcgcgcgtggttttgctgacgtgccagtacctgggccacgtccttttggaacccgtccatccggcgctcaaggtccgaaaatgcgtctatgctggccattcttgtatgtgtgtatgtgttgtatacgtatgagcggttttaattgaatcggcttagcctgtttttgtttttgtttttgttttgttttggtttggtttgatttattttggtttggcttaaatcttcgaggaaatttgcgctttccgcgtaaaaagggaaaaaaagcagatatatgtacaacagaaaagacagagatgttcacgagaggaaggaagatggtcaatctgagtttgaagcactgaacgggaccaacgcaattatgtccgataatagtaaagcgtattccataaagtttctgaccttcaatacatgggggttaaaatacgtctccaaacaccgtaaagaaagactcagagcaattgctgataaattggcgggccactcaatgcttacgccaatatctgacgagttgttgcccaatggtggagatagtaatgaaaacgaagattacgacgtgattgccttacaagaaatctggtgtgtggaagactggaagtatctagcttctgcgtgtgcctccaagtatccgtatcagcgtttgttccattctggtattctgacggggcctgggttggccatactgtccaaggtcccgatagagtcgacctttctttaccggttcccgataaacggtagaccgagtgcggtgttccgtggcgactggtacgtagggaaatctatagcaatcaccgtattgaacacaggaacccgccccattgcaataatgaacagtcacatgcacgccccatacgccaagcagggtgatgccgcctacttgtgccacagatcttgtcaggcctgggatttcagcaggctcattaagctttacaggcaggccggttatgcggtgattgtggtgggtgacttaaactccagaccgggctcactgccccacaaatttctcacgcaggaggccggcctggtcgactcctgggagcaattgcatgggaagcaagacttggcggtgatcgctcgtctgtctccattgcaacaattgcttaagggctgtaccacgtgcgattcgctgctcaacacatggagggcccaaagacaacccgatgaggcatgcaggttggattatgctcttatcgaccctgatttcttgcaaacagtagacgcaggtgtcaggttcactgaacggatccctcacctggactgcagtgtctctgaccattttgcatactcatgcacccttaacatcgtcccacagggcacagagtcccgtccatccacctccgttaagcgtgcgaagactcatgatagagagctgatcttgcagagatactccaactacgaaaccatgatagaatgcatccacacgtacttgaagacagcccaaagacagaaatttttccgtggcctacatttctgggcctcaatacttctcctaatagcgtcgttggtcgtgacaacgtttactgcaaacaaggcaggctggtcctccatcttctgggtccttttcgctattgctgtctccatctcgggcaccatcgacggtgccatctccttcttgtttggcaggtctgaaatcagagccctcatcgaagtcgaacaagaggttctggacgcggagcaccacctgcaaactttcttgagcgagaaatgatattatcgattttctttagcatatgtaaaaaaattactgatattatataatgtgtgtaaatttcgtcaatagatgcaaagcaatcacggagaagatgaaaccgacagataggaacaatacgacaagggagtcgactctgaatccattggcttcgtccgtatataacttcaaaattgagcttgaagacccaccgtaaccagcctgtctggtggaagtgggcgtttgttttgcttgcttttccttaatggattgtgcctgtcttctcttctgcaagatacgctgacctcctggtggaactgaagctgccattcttatgatactgttgatcgataataccacctgttttatgctttgcgccccttaccttttctcacacgcacatatatctactctctcatacctcttatatctaaaatgtctcttttggccagttagtaactgaatgaaaaagtgaaaatggaggaaaaaaaaaaagacgaaatccaaaaggctaaggaaacgggtaacccgtggtacccggggcagaatcaaacttataattactaaagatataccatatattacgatccctgcgcccggcgtgctccacattaagtaaatgtctggagtaaaatgaagtccgccaattcagtcacaaaacatgactactgcctcgttcgcgatttcttcttcccttacttcatcatgttcaagccccctcagctgcgcccaaatgattcttcttatcctcttgcatactgcaccgaaaaaaaaagttaataagcagcaggatttataggcgcgtgcgtgcagccttagactgaaggggtggaaaaactttaggtaggtttggttctcactacccaaagagcaatcgataggtataaaagtgagcaattgctatcacagcgagccttattgttacagcacaaatcacgcgtattttcaagcaaatatcatgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccctttgatctatcagaatctattggaaattggcaggaacctcatccaggcgagaacaaggtttaacgtcaacttggaaccggagtgtgaactgacgcagcaagacctgtcgagaaccgtgtcctatgaaatgcccaataactacacgggccaattcccggaagatatcgcgggcgtaatatcgacgttgtgggccttgccctcaacacaagatttagtcaatggccccaacgcatcgaagttctatctaatggactcgactccttacttcatggaaaatttcaccaggatcacttcgcccaattacagacccacccagcaggacatactaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggagtcgctagtgcttttcgataatattgtcaacagtagatggttcgcgcgcacgtctgtcgtactctttctgaataaaatcgatctttttgctgaaaaactaagcaaagnnnnnnnnnnnnnnnnnnnnnnnnnnnnnnnnnnnnnnnnnnnnnnnnnnnnnnnnnnnnnnnnccggcgggtcagacatcaacaaggccgccaagtacatactctggaggtttgttcagttgaacagagcgaatctaagcatatatcctcacgtgacacaggccacagacacgtcgaatataagattagtatttgccgccatcaaagaaacaattttggaaaatagattgaaagactctggagtgttacaatgaatgcacagttaaaacagagacaaaactgcatgccttctctcccctttattaacacctttaaaaaagataaaaaaaaaaaaaaattaaataaatacgaatacgttttctcatgaccattgtactagtaatcacaaccatgatacttgaataacttttctgttttgtactgtattaagcacaaccgttattttttaatttatagcgttataccactatattattgtagtcattatagttattatcccgggtaataaaaatttcattccaacgaggtaatagttccactttttaggcaggaggacgaaaaacatttgccacccaagaaagagacaaagcagtaggtaaggcattcatcacacaatttgaaagggggtatagtaaaaaaaaattcaattgagcaaatagaatggctagcactgcagtaatgatggacgtggattcctctggggtcaatgacttgcaccattctgagaagaaatatgcggaagaagatcaggttcaggaactattgaaagttttgaatgagatctccaagaccactttaacgctggacccaagattcatatggaggagtttaaaggacttgagctctttaaggaaccaagagcttttgaatgcggaaactttatgtttcacagtgaatgtgctgtaccctgattcttcttcattcaagaagaatctgctgaagttcattacttctaaccataaatcgtccgtaccggggtcagctgagcttagaaactcatatccagcctctttttattccgtaaacactgagaagaagaccattgaagtgacagctgaaattaactgcttcatgcatctactagtccagttgtttttatgggacagtaaagaattagaacaattggtggagtttaataggaaggttgttatcccaaatttattgtgttattacaatttgcgttccttgaatttaatcaacgctaaattatggttctacatctacttgagtcatgaaacgttagcgcgcagctccgaggagattaacagcgacaaccaaaatataatcttaaggtccacgatgatgaagtttttgaaaatcgcttccctgaagcacgacaacgaaaccaaagccatgctgattaacttgatcttgagagattttttgaataatggcgaggttgatagcgcgtctgatttcatttctaaactagaatatcctcacacagacgtttccagttcattagaggcaagatatttcttctatttatcgaaaattaacgccattcaactggattattccactgcgaaggagtacattattgcagccataagaaaagccccacataattccaagagtttagggttcttacagcaatcaaacaaactgcattgttgtattcaattactaatgggtgatattccagaattatcatttttccatcaatcaaatatgcagaaatctctccttccttattaccatttgaccaaagccgttaaattaggtgacttgaaaaaattcacatctacaatcacaaagtataagcagttgctattgaaggatgacacctatcaactctgtgttagattaagatctaatgttatcaagacaggtatcagaatcatctccttaacgtataaaaaaatttcattaagagatatttgtttgaaactgaatttggattcggagcaaactgtagaatacatggtttcaagggctattagagatggtgttattgaagccaagattaatcacgaggatggctttatcgaaaccacagaattactaaacatttatgatagtgaagatcctcagcaagtatttgatgaaagaatcaaatttgccaaccaattacatgatgaataccttgtttcaatgaggtaccctgaggataaaaagactcaacaaaatgagaaaagtgaaaatggtgaaaatgatgatgatacgctagatggtgatttgatggatgacatgtctgatatctcggatctcgacgatttgggattcttataagggcgcataaaaaataaacaactaccattcataacagaaattcattcgtatatacnnnnnnnnnnnnnnnnnnnnnnnnnnnnnnnnnnnnnnnnnnnnnnnnnnnnnnnnnntatatatatatatatatatacttattgatatcaaggtgtgttactttctacattcatagacggggaagaaaagttaggaaaagttgttttctcttgtgcactgcagccctttgaaaaagtagaactgcagaaaaaataactgaacgtaaaagcattatttacttttcaaaggcaaaagagatagagccaaaaaaattgtaagcagctctaaaagccataatgacaacggaagatccagattcaaatcacttaagttccgaaactggcattaagttggcattggacccgaacttaattacattggcactaagctctaatccaaactctagccttcattcaccaacgtctgatgaacccgtacctgaatctacaggaaaagcagatactagtattcgactagaaggtgatgagttagagaataaaactaagaaagacaatgataagaacttaaaatttttgaagaataaagattctctagtcagtaatccacacgaaatttatggctctatgccgttggagcaattgatcccaatcatcttaagacagcgtggtccaggctttaaattcgttgatttaaatgaaaaagaattgcaaaatgagattaagcagcttggtagtgatagtagtgacggtcataacagcgagaagaaggacactgatggcgctgatgagaatgtacaaattggagaagatttcatggaagtggattatgaagataaagataatccagtggattcacgaaatgaaacagaccacaaaacgaatgaaaatggcgagaccgatgataatattgaaacggtaatgacacaggaacagtttgttaaaagaaggagggatatgctagagcatataaatctggccatgaacgaatcgtctttggctttggaattcgtttctttgctactgtcgagtgttaaagagtctacaggtatgtcatcaatgtcaccatttcttaggaaagttgttaaaccttctagtttaaacagtgataaaattccatatgttgcacctacaaaaaaagaatatatcgagttggatatattgaataagggatggaagttacaaagtttaaacgaatctaaagatctcctacgcgcaagttttaataaactgagttccatattacagaacgaacatgactattggaataagataatgcagagtattagcaacaaggatgttatttttaagattagggacaggactagtggtcaaaagctgttggcaattaagtatggttacgaagactctggatctacctataagcatgacagaggtattgctaatataaggaataatatagaatcacaaaatttggatttgataccccacagtagttcagtgttcaaaggcactgatttcgtacattcagtaaagaaattcttaagggttcgtatcttcacaaaaatcgaatcagaagatgattacatattgagtggcgaaagtgtgatggatagggacagtgaaagtgaagaagctgaaacgaaagatatcagaaagcaaatccaacttttgaaaaagatcatttttgaaaaagaactgatgtaccaaataaagaaagaatgcgctttgttgatttcctatggtgtcagtattgaaaacgaaaacaaggtaataattgaactacctaacgaaaaatttgaaatcgagttgttgtcccttgacgatgactccattgtcaatcatgaacaagacttaccaaaaatcaacgacaagagagcaaatttaatgcttgttatgttgagactattattagtcgttatattcaagaaaacattacgatcgagaataagctcacccctcggactgatcaatttgaatgttgacgatgatatcttaataatacgtcccattcttggtaaagttcggtttgctaattacaaactgttactaaaaaaaatcataaaggattacgtgctcgatatagttcctggctcaagtataacagaaacggaagttgagagagaacaacctcaagaaaataaaaacattgatgatgaaaatataactaaattaaataaagagatccgtgccttcgataaactattgaatatacctagacgtgaactcaaaataaatctaccattaactgagcacaaaagccctaatctaagtttaatgctcgaaagtcctaactattgtaatgcactcattcacatcaagtttgcagctggtacggaagccaacgcagtgtcctttgacacaacattttctgattttaaagaagtagaggacttcctacattttattgtcgctgaatacatccagcaaaagaaggtgtaatatcctgagtcactccttaaacctacatacatcgccatagaatgccatttattactatataaagtcgcatacgtacaaaaggacaagatcttatcttcgaaaacaagaatatgaaggatttaataacattgccaggttaagaacggtgtaacaacaatagaagtaacacaacaccaatagcaaacaaaccaactacagatatgacttacacattggcaattttaggctgcggtgttatgggccaagcacttctttccgccatttataatgctccaaaggcggctgatgaaactgctgctgcattttacccttccaaaattatcacatgtaaccatgatgaacctagtgcacatcaagttaccgatctagttgagacattcgacgaatctcctaacggtattaaagtcgaaagcacttacggtcacaacgtgagcgctgtcgaagaagcttctgtagttcttcttggtaccaagccatttttggccgaagaagtgttgaatggtgtgaagagcgtcattgggggaaagctacttatttccctggctgctggctggacaattgaccaattgagtcaatacactagcactgtttgtcgtgttatgacgaacacacctgccaagtacggatatggttgtgcggtggtgtcctactcagctgatgtttccaaagagcaaaagccactggtcaacgaattgattagccaagtgggtaaatacgttgagcttccagaaaagaacatggatgctgctacggctttagtcggttcaggccccgcttttgttctcttgatgttagaatccttgatggagagtgggttgaaattgggaatcccattacaagagagtaaggaatgtgccatgaaagttctagaaggaacagtgaagatggttgagaaaagcggtgctcatccatccgttttaaagcatcaagtttgcacaccaggtggtacaactattgccgggttgtgcgtaatggaagaaaagggcgtcaagagcggtattattaatggtgttgaagaggcagcccgtgttgcgtcacaattaggccaaaagaagaaatagattgctttgcgtgaaatgtatgtatgttcgctttgtagccgtatattatttctttattactgaccttgcattttttcgtcattttcccgtcggtccgataatgaatcatcacgatgaatgactaccccataataatgacactaattggagcgtataaaagaaaaaaattatataaatgtgtttgtaatgagtaagagcaattgattcatttgaaatgaaaatcaaaaatcaaaataaaaataaaactaagcaaccatgtcaagcggcagtactattgtttcgtctgacaagtcggagcgaacatttaagcatgaggaagaactacccaagttaccattacctaaactccgtgacactttgcagcgtctgaaggagagcttagagccattgtattatgctgatggttactatcaacatcctttagatccagaacaaattgagaagctgtcatccataataagagattttgaagagaatcccgtaagtgagaagctgcaatctaaactacagagctaccatgacactagggattgttaccttgatgaattacacttagacatcaataaccagacctctactagggagattcaggacgatgtcctacccaggaatcccttcttggttctcgcagatgacgctttgccaaacatcactcaagctgataggtcagccgtcctagtgcactctgcggccaggtttatttctgctttgaaacaagatttgttgccaccagatatcaatgccaccaatggcaaaccactgtcaatggctccatttctgaacttgttcggtactactcgtagtcctgtttttcagcgcggtgaggttgaaaattttgatttgaacaaaccttacacagcatctgatttagaagaccctgattattcaagcgatgagggcgataacgacgaacccacccaaaaagactttgatgaccgtaaaagaaaacacgaagaagacatattcactggcaatggtataactataaaaagacatccggatagcaaacacatcttgatcatctccaggggccaatactatacactggaagtacttgattcgacgaataaaattatatacactgctgcagaattaaccacaattttcaaccatataataaaagattcttctggcattgaaaaatcaactgcgttaggtagtttgacctctcactcttttagaaactggaaatatgcaaggaagagactacagaaaaggtatcctaatgaattacatcgcatagactctgctctgttcgtgttagtgctggacgagtcacaagaagaaaccaccaatgatggtgatgataccgctgatatcagtcaaatgtttaacaggaccatcactgagcgagacaagaaatgtacttccgccaattgtaagagagtgttttacggtacttctataataaatagcaaaggccatcaagtgggttcatgtgtttctcgttggtatgataaattacagttagttgtcactgcagatgcaaaagccacagtgatttgggattccttcacatgtgacgggtcagtcgtgcttcggtttacttctgaaatttatacagaatcagtcttgagattagctagagacgttaacgccggtgacccacagttttcactctggcctaacgtgacacaaatggatcctgaaactaaaaaactgatgacggcgaccataagtgccgacggcggaggcccttctgaaattgaccctaagttggttgtaaataaaatcgattggtctttcagtaacatcctgaacacacatgtccatttgtcagaaaccaaactagctgatctgatttccaagtatgatattgttcgcgcttctattccattgggcagaaggtcagctcaaagattaggagtcaagcccgattcgatggttcaagtagctttacaaatagctcactatgctttgtatggaagaatggtgtttggattagaaccagtatccacacgtggtttcaaaaactcgagatcatcttttattaacattcaaagtcaagcgctgttggaactatgtcaattgtttatttctagctccattgatgggacagataaattagacaaatttatccaaacctgcgaaacacataataacatggttaaacatgcaaagtctggggtaggttatgaaaaacacttcaatgcattgaaatatctcttcaaatttcatgaccattttggtatccacttaagtggtgatgaatcatctgctgcgaaagatcttttcgaaaatccacttgttttacctttctcacagcctgagttgattgttgccaactgtggtaatgctgctaccacgacatttggtataactcctgctgtacctcatggctttggaatagggtacatcattaaagatgatcaagtagatttgaccgtgacatcgcaatttcgacagggtgacaggttaatgtttatgttaagttgggtgttaggcgaaattcgttcctactggaggatgtcacgcggcacttctcataataaaactggcgtgaagatcagtccagtggtcgataaattgtatgaaatggacaatgcagtcaataatcctccgaaacgtaacggccatacagtcaatggctcccgcaaaacatcttcttcatcacaggtaaatttgaacaggtatggcgggtttttcgatttggaaggccacattgacagtaggaatatatctaaaacaccatcgatgaagaatttgcagaaaaccttcaatggcttgaccatgagcgcagacaatgatcattcaagttccgcagtttccgttcccacagaaaaggaaaaattaaatacaggccatgaaattttacagatccaaccgcgggaagtggcaagtaatgggttggaagcagatgatgagacagatattgaaatagttgctggcaatgctgatggcacatcctcttcggcatcttcagctacatctctaaattccaagaaacgtaacgtcatcaactcaagattcgatattgattttgaccgcagtcgtgtgggtagaaaggtggcgaccttagatcaataagaacgctctttgtttatctatttattactagcattatgcgtaagcttggcgtgatgtgatatatacttgttatatgaagtatatcaatatgctttaatttatgcttattatttgctctcatgtcagtaacccggaccagatttgccattgaaaaaattttcatagaatagcccgatgctgatcatcagtacaaaagacagagatttcatctcgacctgtaccaggagctaagcaaagagggcggaaagagcgtaatacaccgttaacatcgcgcattagaggtagacatgagtgacttacaagaccaagaacctagcattattatcaacggtaatttggaaccagttggtgaaccagatatcgttgaagaaacggaagttgtagctcaagaaacacaagaaacacaagatgctgataagccaaagaagaaagtcgccttcactggcttggaagaagacggggaaactgaagaagaaaaaaggaaaagggaatttgaagaaggtggtggtttgcccgaacaaccattaaaccctgatttttcaaaattaaacccactatccgccgaaattatcaacaggcaagctacaataaacatcggtaccatcggtcatgtcgcccacggtaaatccacagtagttagggctatttcaggtgtccaaacagtccgttttaaggatgaattagaacgtaacattactattaagttaggttacgctaatgctaaaatttataaatgtcaagagcctacatgtcccgaacctgattgttatagatcattcaaatctgataaagaaatcagtcctaaatgtcaaagaccaggttgtccggggcgttacaaattggtccgtcacgtttcttttgttgactgtcccggtcacgatatcttaatgagtactatgttatcaggtgctgctgttatggatgctgcgttactgttgattgcaggtaatgaatcttgtccacaacctcaaacctcagagcatttagctgccattgaaatcatgaaattaaagcacgtcatcatcttacagaataaggtcgatttaatgcgtgaagaaagtgccttagaacaccaaaaatccatcttgaagttcatcagaggtaccattgctgacggtgctcctattgtaccaatatccgctcagttgaagtataacatcgacgcagttaatgaatttattgtcaagactattcccgtaccaccaagagattttatgatttctccaaggttaattgttattcgttcatttgatgttaataagccaggtgctgaaatcgaggacctgaaaggtggtgttgccggtggttctattttgaatggtgttttcaaattaggtgatgaaattgagattagaccaggtattgtcaccaaggatgataagggtaaaattcaatgtaaaccaatcttttctaacattgtctccttatttgccgaacaaaatgacttgaagtttgctgttcccggtggtctgattggtgttggtactaaagttgatcctaccttgtgtagagctgatcgtcttgtcggtcaagtcgtcggtgctaagggtcatttgccaaacatttatactgatatcgaaatcaactactttttgctacgtcgtctattaggtgtcaaaacagatggtcaaaagcaagccaaagtcagaaaattagagccaaatgaagttcttatggtcaacattggttctaccgctacgggggctcgtgtggttgccgttaaagctgatatggcaagattacagttaacgtcgcccgcttgtactgaaattaacgagaagattgctttgtcgagacgtatcgaaaagcattggcgtttgattggttgggcaaccattaaaaagggtactacattggaacccatcgcttaaggaaccaataaaaccactgcaaagacaaaaatttcataattaatctgaaagaaagtgaagataagaaacgggctaggaggaagggaaactgacacttctggttattgcaatatgctcatatacattgatgcgtaatgacattgatgatctttattctctttttataacgttttctttctttttttttccttcttacatagtattcaactgtatatttaacatgttttacgtatttttaagaaaaaattactaaacgcgataatattaagcaaatatttatctcatagttctcgaactcatttatttcccattgatgccatgaaaacctctcaaacctttatcgtctagttacaccagtagtcaataaactgcctttctttttttacacccaacatactctacactaaatcttatcggtggtttgtacatggagacaattgcacaaagataatgaagctccaaaattattcagtatctattgagtatatataaccttgaaaaggttttattttatataagttcgccatcttagtatagtggttagtacacatcgttgtggccgatgaaaccctggttcgattctaggagatggcatatttattttttatattcttaatatacaaagaatgtcgtgtgaagctgtaggcacaggtaattttgtaaccatagtcagatgtggtgatcatgagagcgaattataattttataccagctggcaagaattgagtaatatttagaccagcatataaaagtagaataaaaagttatatgtacaaattttttttgacgccaggcatgaacaaaaactactatggctttggaattttcaagctcttcgaaatcattccacacccatggataaaaaatactagaataattggatgaaattccaatatttggtcttctctaaaaatgccgaatgggatgttatcaaaaattaaaccctttctgacacaatatgccatacccaacaccaaagctagagtggttggcataggcaatccctcaaaatatttagatttacctgtgctagaatctttgggtaattgagcaacggtgacattaaaccttgctaatctcgctaagccgcaaaggacaaagaaagataaaatcatgacatcgaatgtagtttgaaatccaatggcaaaagcaattgcagccggagccacaccaaaggaaaccaagtcggccaaagagtccagttcttgacccattaaggaagacctatttctcagacgtgctactctcccgtcaaggaaatcgaaacacatacccaataaaataaagaaatgggcacgctggacgtaatgaggtttacctgtaagcgtaaatctcagacaacttacaatagagtaaaacccagaaaatccattcagcatagtaatgtaatctgccatatgcaaattcctcatcatgctgaaatgatgttcgtcacttgtaaatttttggatatcagtagcattagggggggccaatggagttgtatttatagaaaatatacttgaggcccttctgcttaatgtgccaccaacttcatctgaggcatacccgtcattttcgtctctgtgttcatttacgataacgtctgtgtccgtgtgtgggaattcttgaggtgcgaaatcttcatctgattcaaccattttttaatatatagttttatttttgttttttgattgaatcaaatagacaactaaaaatgacaatcacccacaaaatgaaaaaaataggtgtatctctctttccttatttataatgtttcctataaaatacggatcttcatctttagatgggtccatgtgaaagctcaaaggcgtgagggtgccgtgtgaacgttcaaagtgattttgaccaattactgatatatattcagtgtctggcacagaagtctgcacacattgagaaggagtggggattgatgttagggatatcttctataatgctactaatttatatatacatcccgtaacaattatgtgcatatacgtacgtacgtacgtatatacgtatatacattccaacccatatatacaaatacttacatgtagaccttgatatttagtatcatggagagctataatggaaaaatcgcagaaacatcttcgcttttatctaaaaagatgtagctataagctctataatcatatctattgcaatggtgtatacagtatttgggtcacgtatttttgtttatacctaacaatggatgcgacacataatgtattatgcttaatactgcttgtcgccagatggttcaatataacatggttcggaatgggaagggcgccagacgtattatcagtttgcgcgtttgagtaactattcaaaatgacgttttctaaatgaggtggcagttgtggaggagtcaaccaggccatattttggtgattattttgctgctgatcaagtgtcaaataatattgttccattacatttgggtcggtgaacacagcaggtatatcttgagtgtactctaaattaggtttagcgggggtctcatcgtgaaaacgagtgtaaccatcgcccatgtcatctggttccttttctatctccaatgcgattctcgagcgagcgctcataggtctcttactcaatttgctatcatctacatgattcgcttttttttcagccagatgctgctgaggttcattgccccaatcaggcggtgcgctcacttccatatagttgacgaagtttcccatttggtcggttgcggtaggtaaataatcactgaatcttaactcattgtcaacaataaatctgaaacgatgagtacctggaggcagctgtaattttacatgcataagtccaggctgtccagggactggtactaacccgatcatctttctccatcccgtaaaagacccagtaacgtacactttattacccccctgttgccaagtgatgtcaactggaaacatcatagctcttcctttcttgccttccacagtgccctgttgctgttcttgttgctgttgaaagccttgattttgaagtgagtcaggctgctgagatggttgataatccattttttgcaaggtatttcctgtcatatctgcatcgtggatatcgccttcgttgctgtcgatactactcgagctgctagcatcgatatcatcatcagaatcaaaggtctccccagaaccattttccgcatggtttgaatatggaggtatttcatcgtcatcatcgtcgttaaaaattaaactcgatttatgtcttaaaggatgctgaggctctaattcattaggattatctacgttcatttgagaaaaagtgtacgccagggaagcctcattagttgaatcggcgctatgtttaccattaatcgtagtgttgctagctgcgtcactgacatctaacatggaagcatccttgttttcagggttgtcgccagccatatttcagtgtagataatttattattgtgcaggaaacgaccttatacaaaatatagtagctcttatctaggatgctctctacttgcgattacaacagtggcccaaatcctacgagatcggtattgttttctttgccacgttttttcgtgagcttttccaaaggggagcaaattggtcgcttaaggatgaaaattagtgcaacaaaaaaaatagcgtggcctgtgttttaacggtaaagacaaattattgaaggtagagcaggactttgaaccggtccggatgaagaccactggaccatgtttcagtctcacatgggttttttgaagcacagcttttaaatttgcaatgattttctccaaaggttttctttgcgtcttcattccaggaaaaagtatatcaagtttcaagaacccattgttattttccttcttatattctatacgttttatttactgcttgtttatttactgaagtaagaaggagcactgttgaaattatcaatttgtcgcaaaatgctctttatcggaggcaatgatacattgggacttgtgttggatgctcttgattcttggcggtgaacgttactgtcctcatcatctccagatatatgaaattgtgccctttcatgttgtctccctctgctaacagcattaaccttgtacttatgattgctcctgcaagctttctgtgttacaggtggcctatcaaaaaatattcccatgcccatgtctttagccgcggtgtcatcatacgtaacagaagtgagtgatgatgaactgctcgaaacggatactgtccttgaaatttccatgtctcctgtgtttacagaaggcatgattcttcgcagaggacttaagtctgttggcggtcttgaaaagctctttgatggatgtgaagtttgagaaagaagcgaagcactggattggtttttagaactactcaaagaatcaggaccactcatggcggccaaattcctcctagatttcgaaaatatagaggagtttgaagacaattcacccagggctaaagaacttccggacgaatgtacatacggtgtagatgcaggatcttcaggaaacccgcttttcaggtactggaatggagaagtagagggatatactgatgcaatggaggtgatagaagtagtggagaggctacttggaatcggatgagggtcatttggaatatttatcacaggcactaaaattgcaggtgcctgtgtctccacaatgccattattatttccagtatttcgtatattcacgtcatcgcaattctgagcaacggagataagaataggtggcactttagattgacctatccccgtgagcgaaacaccagtgttttcattgaaggtggtaggggcggcggtagcagtattcacaacggtttttcgcgagcccttggattttattctgcgcctttggacgcctttagtatgtgtcctcaaatgtctttttagttcatcgcttcggctgaagcttttcggacagccctgaacggtacatttgtgaggcttctcgccagtgtgcgttcttccgtgcctttttttatgttcaagtctgtggaaacctcgtgaacaaatttcacatctaaagggtctttggtcattatccggaggaaatctatctcgcaggtaattcatatatggaatttaagaaaaggatcgccgatgtgcacctactaagagcaaaaggaaatactatgaagcacaccgactcatggcaagaaagggtctctgtttttaaactttatctactaggattaaggaaaaaaagaagaaaaataatgaagcaacaaaaaaaaactggaactgctttgccttccaagtattactgattgaagaacagtatgagggagctaaatcatttatacacggaaaaattagtgaaggattttttggtggggtctccaaggaagtaatttctacggtgtggtctatgtatgtttttccggacgcgttccgccgttttggtttctgccccagaacaccccccataaaagaggtttttccgaagagtgcctttcagtttttccgagatctttatctttttcatccgtattatgtaaacctgaatagccccttgagcaattgagttgcataatagcatgcaattgcatattgaacctcctaggacttaaaggttattcgtcaactaaggaaaaatatgctcataacttacatatctcgtacaccctaaaatcccacacagggattaaaattaaaattatgtttaggtaatgaaaaaatagtaaaaaaatgcttccttaagttaattatgaatttccctattaacacacatgcgtacacaaaaaaagtatacggaaactatattagactacactacatcaaccttattttcttttaaaacctggtgggggctgaaacttccttgtttgagggggcgcttcattattaaacctcgacctatttgcgccgatattatcgttgccaccattgtatctgctcgacgatggttgggcaatctccctagaattgctactagtatgcttcgcattggccgtgttaggtttagcgatctttcccggctttttctctttctcttttcttagtttcgtctgcttttgcgcttgtttcttttcctttttatctctcactagtctttccttcttggatagtagcggcttatcctccaccactgtggataagatctgttctcctcttagtatagtcagtcccaacactcttttttctaccttgatgttcaaagtggttccatcttttgaatcttttctcggtcttaatttatctagttgagttttgggtaccctctcttctatacactcattcaacactaaattcatatgtttatcaaatgccatcaattgcccgatgtaaacgcggccatcttgagtgagaaccctcagcttataatcaataaggttggctagtcggctgctatgtgccacctgtattttgctcattagttatttactttactggaaacctgttatacggatggttctgttaccccttctacttttttccctgtcttgttcatttctaactagcataggcttctttaaatttcattttttattttcataatttttattttgaattttttcccacattatcgtgagaaaaacaagaacatggagaaataaggaagctcggtgggtggttaattggggaacacacctggtaagtaaaattcaatacatggaaggaaagagagaaataatgtctgacgaagcaaaggaaaagcgtgaattagaaagccaaaaggaatcaagtcataataaatccgaaaagtctgtggaacctaagccaaagagaagaagaagaagaaactatgacgattatgacgctgaagtagcaaaagaggagactaaggctaaaaatggtttgacgaagagcgaaaataatggtactgttgaagattctgaatctgatatggacgatgccaagttagacgcattgatgggaaatgagggagaagaagaagaggacgatttggcagaaattgatacctctaatatcatcacatccggaagaagaacacgcggcaaagtaattgactataaaaagactgcagaagaattagacaagaaggaacctagcacaggctctaaagatgatgtaggatatggtgaaaaagaagaagacgatgaagacgaagaagacgatgattttaaagagtagtaagcaaaatgtcgtacataccggcctctacttgtgtattctgtttactttaatttcctatatgcgttctatatgtatataaactatatgtcagcagaaaattgtaaaaatatagcacagaattaaaggggagaagagtcattcacatgcaagtgcgcaactgctgcaaaatatctcttaacaacagttatttccatttgcctttttgttttcgtttggtgttggtgtcagactaatcgttggtccattaggagcggacgcaccattggcattcccgttggcactggagtcaccaaggtccatttgatgcttgctgaccttttgatagatggtattgattaactcttcaaaagccttatccacgttttcactgttcaaagcacttgtttctgtgaataataactgattttcctgtgcaaaagtcttggactcctccgtaggtacagcacgtaaatgggccaaatcagacttgttaccgataagccccactgcgacgttgtcatctgcattttctcttaattctgataaccaatgattacaattttcatatgagcttgatttactgatatcgtaaacgatcaaggcacctacagctcctctataataagcagaagtaatggctctgtaacgttcctggcccgcagtatcccaaatctgcgccttgatcctcttgccatcaatttccaaagttctggtggcaaactcaaccccaattgtagactttgaatccatattgaattcgttcttcgtaaatcttgacaatagattggatttccctaccccggaatcaccgatcagtacaattttaaatagtaggtcgtaatcatacccgtagtcctcgctgctcattgtttaaatccccagacgccgtcagaatccctttgctggcctaaacaaagtgccttgtaataaaggtcaaattgttattcgtttctttcttgaaaagttttgagtttccctctttctctaatttagcacccgcacaccgcagcggtctgtgatattccgcattggaaaatggtaaacaaacaacaaacgagcccaaacataacaacagtagaattgacgcctaggaacaacaatacaacatacttacagcaagactactacctaattagtgcaattagattgcgctgggatagatctgaagctttttttcccattatgagcctccctgttacacctatcaagagcaaagtgtgcagtacattatcgatacaacatgagatggaccatgaccaatgccgtgatgtgttgtgcccacgcgaaaacttactagccattaatagaactaataatatagaaagtgttgctataccgcgacagaggtcgagcaagaacaagaaaccccatgagcatacacaatcgcaggttcgattttccattccagatccaaatgaaatatcacaggactccccactgaaaattgtattccccaagagtggaaatgaaaccgaaagaagaatgtctacttcatcattacttatgaatagccatggtcatttagtcgacatgcactctaaaatactggtcgatgtccctgaagaagtttggaagtttcatcataacaggagaaaaaaatgtgaaagcagacaccgtaaaactcgttctgatgttaggtccaacacaagtagtagtggaaaagaaccaaaccattctagatcaaaatcattacagtcgatcattgtggatacaatgaacacatatcgtgcaaccgaggttgagaccagtattaatgagaatactagtaatattagccaagtatctccgctgaatttatcatttgacaggcctcctcccttaactcccgaaaagaatttatatctcactcctgaatcgccattgaacagatatcatttaccagttccattagaaatatctctgccgccctacttatctccgcaaaacaaggataaaaagaggagtagcttggtttacgatggggatggctatagccagtttcaagaaggtaacacctcatcgtcaactgaatcttctctagaacagccctcatcgtcgtattcagatgaagatgattctattccatatgcccaccatgatgtgtctttcgagttaaataatgcagatgctgataagcttcttggaattgatgagaacgccaacgtcaatctgaagatacaaaggagaaatctcaaaaacccacaacatattaagagtaaaacagatagggaatgtgaggaaaaaaacactgaaaaaaatgtttcattaaaaattctgtcaacaccaaataaactgatagacatccccgacttagagcacatgaaatccccaccaagcacaggtttaaatggaacattaaaatttttccagcagtttgaacctagcgaggagccaacttctcgaactcgccaagttaaccctgaatcactggacaaactcgatatgtcattcaaatttccctccagtactactaacaataatgtggataaggtacatgaaaatagaaactctggagacacgaacaatgaagatttcctgaaagttgatacttcgcctgtgaatcaatcatttgaatccagaagacagatgttaatagacttgcaaaaatccccgacgaataataatccgaggatacataaacataggagaagcaggagcgttcataatattgatgacatttccttaaatttcgaggcaacctccacaccaccagctccgacctctgctccgtcaattcctgttgaacattctaacccatgtacttccattgaaatacctaagagatcacccttacggttcacgtcatctccaaaaacatctgatattcctcctgaagctcaatcacctaaaaatgggtccttcctccaagaaatttcggtaccttcgattcaaattataccagatgaaagtatctctcatacaagagaaccatcaccatcacttattgaatgcccagaggatgaaaacgaagctttttctactgaagttgctgaccattctattgcaataattagtgaaacaaaaagtgttccatcgatggagccattcaaaccgctatcttcattcaattcatttggtcaagaaattcaaaacaaggaaccaactcctttgaaccaaactcctacagacttaattggtaaacaaagaaactgtgtgaatccgcattcaattccatttagcgttttatcttccaatagccaatcgtcacaatcgggtagtagtaaatcttcctacaattctgagttttcttccaatactgccattacggatacaacatctcaaccttctgtgaccattaacaggtcaactttagaacataactttatagaagaaaaacgatcaattaaaaatttaggtcatggtcctccatcccagaagaacaactattcgttccccaggaataagaatactccttcaaatagacacgatttggaatttaataccatttacgaaaaaagagatggtaaaatggttgaggttattcttttagatgaggatgaagatgtaggcctcaaaaataacgatatatcacgaacaagagtctgccatgctcaaaaagctaaaaatgagcaacagaagaaacgtctaagccattgcaacgaaattttgggcatgtgtgataaaactgcagatgatgcaaaaagaattatttatcaactggtaaatgagaagcataaattctcagaaaaaggacaacaaacaaagccaaaaaaatcaagagtacttccgccgttgccttttccactgtatgatgaaaaagggaattctttgatcccgaacaagtatcagtccagtattcataacgacattccatctcatcgcaaactaaaataaaaaaaaaaaaaaaaccctacaaattgttctggtaaacagatttgaccagctcatcgcatgaagatttatcggaatggcaattcgcttattgcctattttattttttcatcggacattacaaaatttcatatctcttacatgtaagaaaaacttctagtttttgtactttcttaaaaaaactatattcagacatgccaattctgtaaaacaaattaataatatgtacttttatatctaccaaagatcatccttggcacatgcaattgattacaaatacgaacattacgcaaaggttttaaagctagtcacctactaggaaagaaatgtggaggctacgggcataaaaaacatgcagtattttctcacgctctctttggcgagctttgaacagaagatggtgtctcctgaatagggcttaatgagtagtcatttgaaaactccggtgtgggtttagtaaatgaattagttggtgtgatagttgtcggtaaatttggtgagattacgtagttatcattgcattttccatctaaaccattcgatatttgatgttgtggcgaacgaacacttgaaggttctacgttttgaccaacattatgattttgatatttactatctctcatttgggatgaagtttttcgggagagtgaattgcagtcataagtattccaattattactgttaaagaaggtgacagtcttgtttgtaagttcaatcttatttttcatcggagctaattctttagccccttggttgatcgttaatttcccattaaaactatgcgtacttctgaaagaggatgacacagatgaaaaaggagagacttctctattcttggagccgccccgtaaaggagatttcagtgtacgacgattaagatcatctctttcagaatcagagaagttaaaatcctctggaatgccattaatttcatcgatgtcgtagtggtcgaaatcaaaaaacttacttttctgattgtattcgtcttcctcagcttcatcaatgaaaaagagattactcattggtctggggacttctgaatctaaatcgcaatttaagtcatgatattttagtgattgagacctagctggcggcggaagaggggggctattgagtacagccgtatactgtgggctcgcatagtgcggctgctgtgaatgagaggaatcaataagttgaaacggagttcttagtatgctactagtgtcatcatcatcatcttcaccatcatcatcggtgattgcaagggcttgtgattgcgcatcagaaacgcttggagttattacaatcttagccggtgtttgaagaatctgcgaatgaggatgattgggaggatgggattctgatttggtttcatacaaagaactttgcagggagacctgcctttctgaatcattggatactaagccgttagaattgttccctcctgtcccagaatcactttcagcgtcacttgcactatcatcaacattaaatatatctgaaaacgactttactgtaggcttggtagagccagtagtacctgtaagggaagccttcattgcagaagtgtgctccgtttcattatccgaattattccttttgagagaaaaactatagttcggctttccatcatgtatgatatttttgttagattgactatagatcccccgtgttgattttgcattcgctggcccactttctatactaggagcttcatcggaaaacatataagactctgcttctgacatctctttgtcgtcgttatcgtcctcatcagacaaatcgaaaaggtcattgtatttttgaataggcttcttgacattatcgtttattagaaactgctctttgttgtcaaccgtttctccaagagatgcatcatcatggtgtccgccatggttaccattaaaagtttctttcccgttttctaattgtttctgataaagattatcactctcattttcatctccattgttactgttatctttaccatcctcctcctcatcatcatcgctcaagttaaaaagatcattgaactttttgactttattgcttttcaaggatgtttcttcgaatcgagtcgataaaccgcatatttcgtttccctcattaccactctcatcatcttctatacaattcatatcgtcatcaaagttctcatcctcatatagatcgtctatgtatacatttgccgccggttccggtttggagtaatactttacagatgatgtccttacgtttatgccggcatattcaaacgaaaattccgactcatcatcatcatcatcatcatcatcatcgtcatcataatcatcatcatgatcattatcgccatcaccgttttcagaagattcgtcattacaatcgttggctttatgggtttctttttcattgacagagtactcatcggaattgttgttgagggaatacacctttttttcttcttttctattaagactaatccttacttttttcttgttcaaggtctcgttttggctatcgtttttgttcacttttgaaggtgatgattgtaagtcgccgtgtcgtatctttggtgagagggaaagtgtttgactataaaaacaaggtgacttgtttattggtgatgtggtttcggaagaggttaaagtggaagtagtggtcactctttcgatgtctaatattttctcatcggtttgttcattagaagattggtcattattaatggtggtggttgaatttccggaaaacgcagcggctagtagactcatatccatttgagaagcctttcccaaatttattatatcatcatgagaatgaattcttgcttgtctgtttctatttttggcaagcgctaatgctttataaacatgatgttccttcttagatgacccgtcctcagcatcgtcgatattttcctgctgtttacccttgttcttgttcaatattcttatggcaggttccaggttagatggtaatgtagttgaagttagattttcattgccaatgataggggttttgaattgtttagaagaagtcgcttcagatgtgtttgatgctggggaagcagtatcgtttaatattattacgtgcgattcgaccttggaatctccccacgaatgagtaattgtgcccttaatagcaggcagagagtctgtggttctattaaaatcttttgcaggagaagtttttttatatgcagtatattcactttcattgtcatgacgtgaaaaggaagaggtagaagaggaaggaaagagcggcggtggtaatggcggcggaggtccagtattttttgtgggtggattttggagaacaaatgagtttgaagtagtctgatttgtgcttgtggttggagttgaagctaaatgcgagtttaagtttgagtttgaagttttcttgaacaactttgaagtcttgttagccaaacgatggaaagactcaaatccaggtgagtgtttcgcgggtggtggaatgctatcgtaattcatttgtgatggtgtagatggtagaaagtctaaggagtcatcacttgacctttgagaactattattagtattgccactgaagttgctatgtcgcttggggctttcatcaaacgacgtggacttcttatgggcttttatgaaagaccgcatgatgaaatattccagttatgcgtgtgcgtcttgtgatgcagatccttttgggcaaaaacagttggtttgtgcgaaaacgcaaggtaataaataggcttaaaggaactaaaaaaaaaagaggaaaataaccagctaagatttaaggtacaagaaagcggttgcacctcaagtaatgatagttattaaaccttggattggaccagatgtttaaaattgttttcaatagtagatttgcagtcgtaaatgcgtgctcagcaatatcatattgtgtttatgaagtattaccaaacgggtagaagaacggtttaagagaatatgtccggataaagcgatcaggagaaaagcttaaaacccaaagtggtcaatctgcagcccatttaggcactctgcatttaactgatacccggattaaagaaagctggcgggtgtatgggtgaaggagaagaaaggaagtgattaggagaaacctcatggagatgagcacatgctacaactaataacgttattctacttaaaacgagaaaaacaaaaaaaaaaagaagacaattgaaaacgcaatggatgcattcagcttaaagaaggataatcgaaaaaaatttcaagataaacagaaattgaaaagaaaacatgccacacccagtgatagaaagtaccggctattgaaccgccaaaaagaagagaaagctaccacagaggagaaagagcaagaccaagaacagcccgccctgaagtcaaacgaggacaggtactatgaggacccggtactcgaggacccgcattctgcagtcgccaatgcagagttgaacaaggtgctaaaagacgtcctcaaaaatcggctccagcagaacgacgacgccacagccgtcaataatgttgctaataaagatactttgaaaatcaaagacctcaagcagatgagtacggatgagctcaatcgttggctcggacggcagaatacaacatcggctataacagcggctgagcccgaatcatcagtcgttacccttcacgtacaaggtgatcatgatcgtgcgggcaagaagatcagtgccccttcgaccgatctaccggaagaactagagaccgatcaggatttccttgatgggctgctctaatcgcgcggtacgacagttactgcgtggaaagattatcagcgcccctttttttcttctttgttcttaacatttctttttcttgcggcttatgcccgtacttataaaacaacggcctcccgtgccctattaccttcctgatagcccggacaataacgtcactacatacaaagttatacactaacagaaacacaaacacaaacgtttttataatagtcaaaattaaatatctctcataatgggttccgagacaaaacattctgcaaaagtcaagattgtcacaagggaaagtcctccttccgccaaggagcacatgcgccccactaaaactcaaatattagttccaccgacgcagagtttgcccaatggcaagaaaccaaacttcggtaagtctacaaaacagcggcgagaacctagggaacgcacctcgaagacgggacacgaggacgacaaggcaacgatggtcactgttaacatagatgccttcctacatgataaggcccctaaaaaaaaatcgtgcaaatacaagaagaagaaaacaagacagtaccaggatagggcggcggcgtcgatcgattcgaaaccgcacgtagctggtcatacagcctttgccggtgcttccttcacaacagatatcccacatgaggcagcgctacccaaacctagttttgtttgagtagctgtgattgtaaatttttttatttctacttgagcgggcgggctctcatttttttttttttttggggttttatttaggtcggattatttataaagatagcatttatatacatttttacgcaattaccctcatattcttacacatacggagaagtcattgttatattttcttgcctcaacattgttatcggtgattttctttctttattgattgattagttatataaattattgctattaaaatacataaaaggggaagtaaaaacgtgcacggcgcagatcaacttcacaattacaaaacaacgttcttggccaatttgttcttatattgcaaaatggatccgtcccatctggtagcggtcttgttttccacaacgaaaatatcttgggcaattttgtctaataatctgaaatcatgcgaaacgacgacgacaccaccgttaaattcgttgatggcgtcggccaaggagtcgatggttgggatatccaaaccattggtaggttcatctaatagtaggacatttggttgttctaaagctaataaagcaaagacgacacgagaacgttgaccttctgacaaggtagccatttgaacggtttgaccttccccggttagcccgtagcgacctagttggcctctccagaattggaaatcttgtgagatgttagagtacttgtcacggacaaattctaaagcagattttgtcaagtccagttgatcttgagaatgttgcgagtagacacccaacttgacatgggtatgtctagaaacacggccagattgtggggtcaattcaccggtcataatcttcaacaatgtggatttaccaacaccatttggtccgacaagggcaatacgtgagtccatatcgacaccaaagttcaaatgttcgtacaagttttcggatgggttgctctcataatgaaatgaaatatcatcgaatgctaaaactggtggtggcaatctttccacttgtgggaatctaaatgagaaaactttgtcagggacgacaggttggactaaaccatctgcttccatcttgtccaaaattttttgtctagatttagcttgtttcaccaagttagcataagtaccagcagatgcaatgaattttttaatatgttggatttcctcttgttgtttattgtattgtttcatttgattggtttccaattcggatcttgtcttgtgataagaatcgtagttaccaccgtaagcagttagtttttgagctctcatgtcaatcatattggtacaaacaccgttcaagaaatcttgagagtgggacaccaaaactaaagttctgtcaaatctcttcaaatattcttctaaccaaacacaagcttccaaatccagatgcgcagtaggatcatccaacaataatagagttggcttaacgaaaagagcttttgccaacgcaacacgcattttccatccaccagacatatctttcgttttcttcaaaatggtcttcttgttgaaacctagaccgatcaaaatgatagcagctctagattcaaaggtgtctggatccaaagagtccattctttcatatagaggctctaataactcggactcaggaccatcttccaagatagtcttttcaactaagtcttctattcttttcaattcgtgttgagcttcagtgacaacgtagtccaaggccgacaattcacttggttccgcaggttcgtccaataaataaatatcaatatgctcaggaataggatattctctagtagcaagagcctttaagaatgttgacttaccacaaccattttctcccagaagaccatatctacggccgtagtttaattctaaaccagaatcttggatcaaaactttaccgtggaacagtaaagaaacagaagatagcttgatatcacgggaagtctccaatgaactcaaaacaccagtgacaacacgatctgaaagaccatccttatcttgttgcaacttcatcatcttgatttctctagcggctgcatctacctccgattcttcagcagcagcctccttttttctacctagctttctgatggttttaccggcagcggctttcttagcctctctttcagctttcttagcatctctcttggcctttgacgcagatactggtggcatatttggttctgtcaagttactgtttgtagtactgaggggaagaaaacaatttttgcaagaaaaaagttaagaaagaagaagaaaaactacacgggcactaacatgttaaatatgataatatttttttttataagagaatcactaccaagttacctgaactacgtcaaggaaaagccattaattgagatgaggtgaacaaagaaaaaaaaaaagaaaaaaatttttatttttttttccatcggtctccccctcacctttcttttttcattcgtttaaagtgagataagggtaatgcatttcgtatttagtgagtaaacgtcaaaggtgatatagggggtttttctttttccagaaaaagaaagaaaaaaagccggcggtcgccgccggagatggttgagaaaaaaagggggcagcaacgtgcttcacatacaaaccaagttcttggatctgtacgatcgtttctgcgggtttttccgtatttgccgcaatactgaaatggctcattattaggagatgtgcatataatgtatatacatacatttagcatatgtaatacattcgtacatgtatagaaatatgtgtttatatatatatatatatatatatatatatgtatatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatatacgaactcggtttaacgcatagttggtaagagatttaatgtagataaaaaacacataagttttatacgcacgtaatcatgactatcgctaaagattacagaacaatttatagaaaccaaatcaaaaagcagatacgactaaatcaggagcatttgcaaagcttgacacatctaggctcacaaatcaatttcgaggtggatcctcccaaattaccggatccggatcctgctcgaaaagtatttttctttgatatcgataacactttgtacagaaaatctacgaaggtacaattgctcatgcaacaatcattatcaaatttctttaaatacgaattggggtttgacgacgatgaggcagaacgcctaatcgaatcgtattatcaagaatatggattatccgtgaaaggtttaataaagaataaacaaattgatgacgtcctacaatataatacattcatcgatgattccttacctttgcaagactatttaaagcctgattggaagttaagggagctgctgatcaatttaaagaaaaaaaagctcggcaaatttgacaaactatggctgtttacaaactcgtacaaaaatcacgccatcagatgtgttaaaatattaggtattgctgatctatttgacggcataacctattgccactacgacagacccatcgaggaagaattcatttgcaaaccagatccaaaattcttcgaaacagctaaattgcaaagtgggttgtcgagctttgcaaatgcctggtttattgatgacaacgaaagcaatgtgcggagcgcgttgagcatggggatgggccatgttatccatttgatagaggattaccaatatgagtcagaaaatattgttactaaggaccacaaaaataagcaacaattttccatattgaaagatatccttgagattccattgataatggacgttgaagtttaccgtccatcctctattgccataaaggaaatggaagagttggaagaggaaggggaagcagtcaactggtcaaatcaacagatcaatgttcagtcatcatgactgttatctgattttagaaaacaaatttaatattcccttcaggatagaaatttcaacatcatttgtcgtttcattagaaatatccaaaatacaatctttgaaatattctgttacttgacatttgggaccaaaaggaataaatttcgagccatacatcgttaaaataaaatatagtagatttttatagtttttacaatcaaaaaattcgttaaactctttgattatattttgctgtatagtttcagtccggtcttgcttttcactaaagcgtctcctgagcaaggcgctttgtaaatgagggaagatttgtagtagcctataatgtaaaaaaaagtcgttcttgtccacaatttcgaaatatgaatttatgaaatgtgcctcattaaacaattccaggaccttaaaacacagtctatgatccgattccatagcgttaaaaacctttctatccaagattaaacatatgaaggctctcagaaagaattccctaacatcatcattatcatcatcactataaaaatacattagaaatttgagcattttgttgacggggaaaattgtgcataaattatcatatctagaattttcctttttctcgtagttgatttttaacgagttacacttttcttgattgacgccaaataagaccagtaaattcgtgatgcttgggcatttcaagcgaacaaattcaggaacttttccttgcgatctactactaccaaacaggaatgaatacgccgtatctttcatttccaaatccatcaattgctcgtaatggcagttttcagagatgaaatgccaatctttatatttatctgatatggtttccttggtaaccacatccaaataaatttctgggatagacccagaaaactttatgcttttttgtaactcacttttggctacagtgttactagtaataactatgcttttgttgcttctaggtgaatccaatatttcttttttcaagtcttgtagcttagccactgtagtagtgatcgtatcgtcgaagctatcacctagattgaaaatttttaaaggtacgtaattgactaattttctgggtgtcttgacaatctcctcatcctcgttattacttggtgcctttcttttggaaatgatggttctttttaagattggatcaaaatcttctccagactccgccttggcaccagaaagattcaaatcgctgttctctaggctagaaaactcttcgtcgctattcaaactgtcgttctcaggatcactaataaagttaggctgcaccttctcatcgtcatcgtcatcgcgaaagtaacttcccacactagtcggtatcaaaggagaatcaaaccctgaaatttgtgaatctggcacagtttcaaactcttcattcggtgatgagttcacgcttcccatttgtgacactgcccttttgtgcgtctaacaaaattttatcactttattgctatttacttgaaaaattatatatgaatatatttcataaaacgatgctgacataatatgtaacataaaaaaaggaataacctaaaacaaaaacaaagaagaccccatataaatgaatataaatgtatattttgcttgagcaaatgaagaatgtactacttctcaagagtagctgctagaactttttgctgttgtatctttttctgtttagccacagcgtacagcaggccagacagaaatcctagaaagatagaaaagaaggacaaaaagttttttggagcgtcaaagaacaccaatcccgccaacgctatgggcaatttgttcaaagcaccaaccatagaatacgttgtagaggaagttacacgaacacaccagccggaacagtacgatatccccacggacatgagcccgctgatgaccattgctgccagtgagtcagcggacaagttcacagacaaattctttgtggaccagtcttccataatgaaggaaaagactagcagcaaaggcaatgccagaacgttgttataaaacatagtatcatagtctttaaagttagtcagccgaattctcttccgcataatcaaaacgaacaatgcagacgaaatacaattggtgaacatccagaggtaccccggattctacacaaagatggttgactcaacaagttcctgatcgagatcctccaaagatgatgctttgattgcaatggcctgctgatcgccccaggtggccactacagatgaaaggaccatcataataaatgacgtcaactccatagaagtgacttttccgccaaagaagaggacctcgccataggcaatgagaatgatcgtcagattcttgaaaattgtgtagatgggcacggcaaggtattgtaagctctttgacgacgtataaatcatcaatacgagcagcaaagaaattggaaaccagttttttacatctgtcctgttcaaagatcgaaaattagcaacgcctacaattcgtaggatacatagcgtcacagtgcacaccagtgattgtacaaacaacatcacaaagttcatgttaaagttgtccaggttaaccacgaatttgttcgttactgtcatcaaaatcgaggacgcgcagtaagataagattgaagccggcccagagttggccactgattccgtccattcatgcttatgcttgctcataattaccacactttcttgatctctttacagcttttcaaccttccattcttgtactctatctctacctggccctttaaacattcttaacatgatatattcacattttttgctctgttacccgacggacaggttcccgaaagaaagtgacatggcaatgctgagagagtggaaagagtcatcttgcaagacagagaaagatgttcaagagtggtaagctaatgtcagcgcagtagcccatcccacaataacagagtgtgtaagaaagagagacgagagagagcacagggccccctttttccccaccaacaaacaaatgcaagacgaccccgaaaattcgaagctgtacgacctgctgaatagtcatctggacgtgcatggtcgaagtaatgaagagccgagacaaactggtgacagtaggagccagagtagtggcaacaccggtgaaaacgaggaggatatagcatttgccagtggattaaacggcggcacattcgactcaatgctggaggcactgcccgatgatttatattttacggacttcgtgtctccttttacagcagctgccacgaccagcgtgactactaagacggtcaaggacaccacaccagctaccaatcatatggatgatgatattgcgatgtttgattcacttgccacaactcagcccatcgacatagccgcatccaaccaacaaaatggtgaaattgcacaactttgggactttaatgtggaccaattcaacatgacgcccagcaactcgagcggttcagctactattagtgctcctaacagctttacttccgacataccgcaatacaaccacggttccctcggcaacagcgtctccaaatcctcactgttctcgtataattccagcacgtccaacagcaacatcaaccagccatctatcaataacaactcaaacactaatgcgcagtctcaccattccttcaacatctacaaactacaaaacaacaactcatcttcatccgctatgaacattaccaataataataatagcaacaatagtaatatccagcatccttttctgaagaagagcgattcgataggattatcttcatccaacacaacaaattctgtgagaaaaaactcacttatcaagccaatgtcgtccacgtccctggccaatttcaaaagagctgcctcagtatcttccagtatatccaatatggaaccatcaggacaaaataaaaaacctctgatacaatgtttcaattgtaaaactttcaagacaccgctttggaggagaagcccagaggggaatactctttgcaatgcctgcggtcttttccagaaattacatggtaccatgaggccattatccttaaaatcggacgttatcaaaaagaggatttcaaagaagagagccaaacaaacggactcaaacattgcacaaaatactccaaatgcatctgcaacttcctcaacttcagtaaccactacaaatgctaaacccatacgatcgaggaaaaaatcactacaacaaaactctttatctagagtgatacctgaagaaatcattagtgacaacatcggtaatactaataatatccttaatgtaaataggggaggctataacttcaactcagtcccgtccccggtcctcatgaacagccaatcgtataatagtagtaacgcaaattttaatggagcaagcaatgcaaatttgaattctaataacttaatgcgtcacaattcgaacactgttactcctaattttagaaggtcttcaagacgaagtagtacttcatcgaacacctcaagttccagtaaatcttcatccagatctgttgttccgatattaccaaaaccttcacctaatagcgctaattcacagcagttcaacatgaacatgaacctaatgaacacaacaaataatataagtgcaggaaatagtgtcgcatcttcaccaagaattatatcgtccgcaaactttaactcaaatagtcctctacagcagaatctattatcaaattctttccaacgtcaaggaatgaatataccaagaagaaagatgtcgcgcaatgcatcgtactcctcatcgtttatggctgcgtctttgcaacaactgcacgaacagcaacaagtggacgtgaattccaacacaaacacgaattcgaatagacagaattggaattcaagcaatagcgtttcaacaaattcaagatcatcaaattttgtctctcaaaagccaaattttgatatttttaatactcctatagattcaccgagtgtctcaagaccttcttcaagaaaatcacatacctcattgttatcacaacaattgcagaactcggagtcgaattcgtttatctcaaatcacaaatttaacaatagattatcaagtgactctacttcacctataaaatatgaagcagatgtgagtacaggcggaaagatcagtgaggataattccacaaaaggatcttctaaagaaagttcagcaattgctgacgaattggattggttaaaatttggtatatgaccgcgtattatcgttatcattattcttattatgttaataattactgaacggttgcattgatagattttcattacctctgaccacaatcctgagcattggtattatttgttttgctattttcagatcaaattacttgtaaaaaaagaaatggtagtatattggcattgaacactggctgttctatttgtattacttttatatgtagacatatattattaggaatttgtaatatcactctaattattatttgatattctttctctatctcccctgtttcttttgtctatctctttctttttttttaaacggcccttttttaatggcattttctttttcttataatgcccacagttgaatgatttaactagcttttcactgacacataaacaataatgtatatgatccatcgaatgaaatgacagttctattgcattttacctacttgtatattctggatactgcacaagaaaatgggtgtctcacaaatatgggaatttttgaagccatatctgcaagattccagaattccgttgagaaagtttgtcatagactttaataaatcgcaaaaaagagctccaagaatcgcgatcgacgcatatggatggctatttgagtgtggatttatccaaaatatagatataagcgccagatctagatcaagatcaaggagtcctacccgttctccgcgtgatagtgatatcgacagtagtcaagaatattatggtagcagaagttatacaactacaggaaaagctgtgataaacttcatatctcgattaaaagaactactgagtttaaacgtcgaattcttacttgtatttgacggagttatgaaaccctctttcaaaaggaaatttaaccacgaacagaacgctacttcttgcgatgatgagaaagagtactattcaagctgggaacagcatgttaagaatcatgaagtttatggcaattgtaaaggattgctagcgccatctgaccctgagttcatcagtcttgtacggaaattattagacttgatgaacatttcatatgtaatcgcatgtggggagggagaagcccagtgtgtttggctgcaagtttctggggctgtagatttcattttaagtaacgattcagatactctcgtatttgggggagaaaaaatcctgaaaaattactcgaaattctacgatgattttggcccaagttcaataacttcccacagtcccagtagacatcatgatagtaaagaatcttttgttactgttatagatctacccaaaatcaataaagtagcagggaagaagtttgatcgcctgtctctcttatttttcagcgtgctattaggtgccgattacaatcgtggagtcaagggtttgggtaaaagcaaatctttgcagttggctcaatgcgaagatcctaacttttccatggaattttatgacattttcaaagatttcaatttagaagatttgacatcagaaagtctgaggaagtctcggtatagattgtttcaaaaaagattatatttatactgcaaggatcattctgtcgagctatttggaagaaattatcctgttttattgaatcaaggttcatttgaaggctggccatcaactgtcgcaatcatgcactattttcaccccattgtccaaccatattttgatgaagaagttctcagtgataaatacataaatatggctggaaacggacactacagaaacttaaatttcaatgaactgaaatattttttacaaagtttgaatttgcctcaaatttctagcttcgacaagtggtttcatgattctatgcacgagatgtttctattaagagaatttttatcaattgatgagtccgataatataggtaaaggtaatatgaggattaccgaagaaaaaattatgaacatagatggtggaaagttccaaataccatgttttaaaatacggtatacaacattcttgcctaatatacccatttcttctcaatctcctttgaagcgcagtaattctcccagtagaagcaagagtcccacacgacgtcagatggatataatggaacacccaaatagtctttggttacccaaatacttgatacctcaatcgcatccattagtaattcaatattatgagacacagcaacttatacagaaagaaaaagagaagaaaggtaaaaaatcgaataagtctcggctaccacagaagaataacttggatgagtttttaagaaagcatacttcgccgattaaaagtatcggaaaggtaggcgaatcgagaaaggaaatcctggaacctgtgagaaaaaggctttttgtagatacagacgaagacactagtctggaagaaatactggctcccacaagactgaccaccgtcgatgaacacagcgataatgacgatgattcgttgatttttgtagatgagattacaaacagccaaagcgttttagatagttcacccggtaaaagaattcgggatcttacacaggacgaacaggttgacgtttggaaggacgtaatagaaatatcaccaataaaaaagtcaagaactagtaatgctgagaaaaatccgcctgagtctggtttaaaatcacgctcaagcatcacaatcgatgctcgccttcaaggtactaagatgttgcctccaaacttgactgccccaaggttagaaagagaacactcctctatccttgaccaacttgtcacagacgcacaagatacagtcgaccggtttgtagcctgtgacagtgatagcagtagcactattgaatgagtttacggacccagcgtcaaaaaatccgccaccacagttgatcgcgccgaaaacgagggagttgcgatgagtaaaatgaagggcatatataaacaagagtagacagagacacatttttcaatatcatatatatagatttaattggaaagacagttatattctaacgtcaaaaacttaacaagtaaaccaaattgcaatgtcgtcgcttatttcaaaaaccattaagtatgatccagccaaggataaattaatcacattagcatgtggatgtttttggggtacagaacatatgtataggaagtatttgaatgaccgtatagtggattgtaaagtaggttacgctaatggagaagagtctaaaaaggatagcccctctagtgtctcttataagagagtttgtggtggtgacacagattttgcggaggttttacaagtatcctataatcccaaagtgataactttgagagaattaactgatttcttttttagaatccatgatcctactacatctaattcacaaggacctgataaaggtacacagtatcgcagtggattgttcgctcattcagatgctgatttaaaagaattagccaaaataaaggaagaatggcaaccaaaatggggtaataagattgccacagttattgaaccaatcaagaacttttacgatgctgaagaataccaccagttatatttagataagaatccacagggatatgcatgccctactcattatctgagagaaatgtagcttctttagtgtacgtgcccttatttatgaaaaaaagtcaagtgcatgaatgaaatatttactgttgaagaatttattatatatataggtatacaggatctatcttttcgataacgtaacttagtatcacatgtattagtattaatactgcgataggattgttagctgttgtttttatatttgcaatttatttatgatcttttttgatgatcaaaccgttgagtttttgaacattaaaaaatagtgagaaagaagaactgaaatgggaattgaattgatcagtatctgtagtggtcggccttgaatggaccttcttctgggatacccaagtattcagattggactttactcaatttagtcaatctaacacccaagttgcccaagtggaacttagcgacagcttcatccaagatctttggcaaaacgtggacaccaacttcgaatgggcctgtcttttggaattcaatgtgcttttctctgaaagacttatcgttagacttgaacaaagcaatttgagctaagacttggttagagaaggaacaagacataacgaaagatgagtgaccagtagcacaacccaagttaactaatctaccgttagccaacaagatgacgtgtctaccagaagacaacaagtaacggtcgacttgtggtttgatgttaatacattctttagcgttagcctttaaccaggcgacatcaatttcgatgtcgaaatggccaatgttacaaacaatggcatcttctggcatgttgatgaaatgttcaccgttgataatatctctacaaccagtggtggtaacgaaaacttgaccaatgtgggatgcatcttccatggtaacaacttggtagccttccatggcagcttgtaaagcgttgattgggtcaatttcggtaaccaagacacgagcacccattcctcttaaggcagcagcacaacccttaccgacatcaccgtaaccagcaacaacggcaaccttaccagccaacatgacatcagtggctctcttaataccgtcgactaaggattctctacagccgtacaagttgtcaaacttggacttagtgacggagtcgttaacgttaatggcaggaacctttaacttgccttctttgaccattctgtataagtggtgaacaccggtggtagtttcttcggaaagaccaaagcagtcttccaacatttcagggtgcttttcatgaactaaagtggttaaatcaccaccatcatctaagatcaagttcaatttcttgttgtccttgaaggcaaacaattgttgttcaatacaccacaaatactcttcttcagtttcacccttccaggcaaaaactggaacaccggaagcggcaatagcagcggcggcatgatcttgagtcgaatagatgttacaagaggaccaggtaacttcggcacccaaagcaactaaagtttcaattaaaacagcagtttgaatggtcatgtgcaaacaaccagcaatacgggcgcctttcaaaggttggacgtcaccgtaagcctttctgatggccatcaaacctggcatttcatgttcagccaattcgatttcctttctaccgaaggcagccaaagagatatcagcgattttgtagttttgagctggagcagacattgggaattgttctttttgtcagttgggttatttcgaggagaagaggattttcagaaagaaagaaaaacaaatgaggaatggaatcatggagttaataaaccacgttactaaataagagattggaaaatctaaaatacggcttcgaggtcgtttaattttctttttcctctgaaaattttctttctttttcggccttagcctgtgaaaatttcggccgaaaaaaaagccaacgagatcacgtgcacagaaatatctgcgttagaggagagaggtaaggatacttacagaaatgaagccaaattggcagctttttgagaaataatcatgaatgataaacaattgctgttaaataatgtacggaacgtttggataaaggttgctataggcattatataaataaatcatctctatataattttttttacaggatatgcttgcccttacatcagaattaccaagcaacaccagtgtagtattctctttgtttgtacatccaaaccaaagaggtggttgagacaaccaatggacccatgaatccctttcccaacttacaagttctaaagatcaataattcagagccgaagtggaatagggcaaccatataagacatgaagaccaattcgaaaatgtgtggttcattcaagtacatagccccatagaatctgataacacaggaaataaaggtccaagtaccgaaagttcttgcactcaaatgggttgtttcagtgggttttctttcgtagactttacgtgtcaattctaaaccagaaacgtaagtctggatagaattgaagactgatacaatggaaatgaaaagtaaccattttggtaagtaaccttttggcattgctgccaaggtggtcttggttgtagttattacgtcttgtaggctgaacattatctgatactttagtgtatttgaatccttcgatattatggtctagctagtgtcaagaatataaaaacctgaaattagtcaatgcgtttacgtcaaaaatagtagcaatagtaaagcaaaacaacaggcttgttcagcttagttttatatacgggggtagagaatacaatggatcgtacctttttttttgtttcctgttcgttccgtccccgaacgaaaaaatcataaaatagaagtttcctatcggtaataccgtaaagtttaattcagttcgtataagattaggttaatcatggacaagtccggaagaagcgttttaatgtaggtctgttggggaagatgttgtgttcactgtaattttcaactgaagttgttgtccccgaaatgaaagagctttcgatatttttgtgttttataatgcgcctcctactgcaaaagaaaaattaaatgttttctgtctcattgaaccatcttgacaatcgaaagcgcgctatcaaatttctttcggcagtaattaataaggccgcctgtatatatttccttttcttctgaagcgatatttcatgagccggaaatttttccaggaaaggttttaagtgctgccattcaatgctttcaaatgtctcgagcaatgatagaataactatcttgagtattttcaatagaccccctaactctttttctgggacaccgcttattacactgtaaaagttctttaagtaggttttcttcaaactcaattctctttcgaggtatactcgacagtacgcctttttccggttgatgcatattagtttatgcttcgatacaaatctaataagtacatgtatcagactttcgatgatgataagtatgtgttcaattaatttcagaacagatacgtattttaatatctgcggttcaaatgtttggtttgtcttgattttgatgagttgaatgttaataatagagtaaataaaggtaaaatgcaacgaacacaagcgcttgtagtcaactttatcacataaatgtttgccatctccctggtcgtaaaagttttgaagccattttggatcgttttggttcttcttcaataaaattctattaaacagaaacttggcgatgaaattgaaaacatgaacgtctatcagtgtcctcttaaaagaagaatcggaatctatgcgatgcgaataatgagaaactaacaagacttggagtgtttgaaacacttgcgataaccctttaaagtcaatttcttttgtttttaagctcaggatttttagcagaattttatatctcggtaaaaaccagttgtttatatcagcagttgatacatctttgctaaatgattgcagctcctttaaaccaactgcatcttcgaagcttttgtacttattctggcaaaggaaattgtatataggttccagatgagcaaacagtgatttattattcaaaaatccattttcgaaaggcgcaacccatttgtatatatgttttgagttttcccgaggatttatttttaaatttttttcactcttgagagcacctacatcttcgacatctcctttctttcttgaaagtgccctcttccacaacgtaggattcctggattgaattaaagcaaaacactgtcatagataatattcgaggagattacacctcttactaaaagttagtaaagagaaaataggttaaggatgtgacaatttcacgtacgattatccagtcaacttccgatgtttccttttgttccatatcttccagtttgcctctactcatgtccttattcttctaaaagattatttaatgaaactctttcataactacaagatgtttgttatgttttcttttacaagtcggaaacatttagccgcccagcgatatatatgactccgaaagaaaatgaaaggaaatacatacatagtaaaataaatcgtttaaacataaataatcatacagaggaaaacattaaggaaggagagtcaaactaatgtactgggaatttggatctcttataagaagtatgcgcaatacttttactcatcatatagactggagctgcgtatcatttcttcaatcattttcagaaatacgttaacatcacgatccttgttttgaaggctttgataactattattaccaccattaattgtgcattcttgcatgtgcaacctcgaaattttcttcattttttgaaccagtttttcgtaattttcaatttttttcttcatcattgtgttttctttgcttatttggtcaaattccctttgaagttgtaattgtgacattttctttctttgtcgacacttggaagcggcaattctgtttcgttctagtagccttgcacgcttccaagctttagcaccgtctttcaagcctgcagtattgttctctattttttggggtctagcttcctgctttatttggaaggttgctgtagtgtgcatagaggagaagggcgcggtatgtacgtctttctcactattaatattgtttttcagtgcagaagtggcatccttgtattgtggttttgagttggcatgtgttaagttgacatcagggcatttcgattcgtatggaaggctgcttgaaatattcaactcggcattttggcaggaattattaacagtgtggtgattaacgccatgggaaattgaagaatggacggattgattttcgatattatgatcattaatgttttggcaggaagaagaagaggaaacggaagaattagaagctggagtacatggatgcacattcaattgagcatttttccatgccttagtttgcatttgagcttgtaatcggagttgcatgttgatgtaagcctgattcattgtggaatcgccagatgggatagaaggcgtggcagaaggaatgtcacaagtggctgctactgcgggtatgttaagctttatattgctatcatacggggtcattgcagcgtagatattcttgctacctggttgaggtgcagcttcgggtatgactgtagcttgttcgtgtggttgtggcacgttttgcaattcgttcgagctaaagcttgggtatgtggctgcgcttagatttgccacctgttgaggattggaattctgttgcgccttagacgatagaatcggaggctgacagttgtaaagattttcaaccgtttctaagtcttcgcctaattgactaatctgaccattggagatagatatgcgtcttttgtacacgggctgatcaaacgctggtaaagaactttgaaaaatgggagggttggtgatgggaagatggctgatgtcgacgccaaagggttgaaacattggacccaggttttcttgcacgctacgatcatgcaaactgttttggtgatgaaaattgtaggcagaatccacaggaccaggacccgatggttgtttgtatataagctccttgtttgaagatagaaaatctgtatataagagtgggttctgccttccatctaggaaagaatctggacttgtagcaaaattatgcttatagtccatactttatttggttccttagttgttacctggtgttattccagtactattaatataactcagtacaattagctgccgtagaaaaaaaaaaaataataagaatacagtttctgcgcttttagtcggtaagcactcagattgagagatctagatttactatattttaataataaccagttaaagcagattttgaagatgaactaacataaaaaaattgatgaattatgtaacataatcttctgtaccaccagggtaaatcgtcaaagaatatctgcatccaagaacaaaagaaaatggtgcagtaaatatctttcagatgaaaaactaattatatatcactactaaaaaaaaccagaaaaagaaaaaaagaaaaatagaaaatagaaaaatagaaattaaaattaagagaattttaaaattaaggtctacaaagtaatacttggcatattgcttaactcctcacgcagaaccttagcgtaccactattttatctgataccacaaaaagctgcgctttgatggcccaacggggatataatcgcgccactgctactcatgtgctgcaaactaacagtgccagcagaagcgagcattgaaaaactaaactttgccttgttctgcttacttcatgcagaggtacagcttcgacgtcctaaagttgaacatcatcttgcttcgatttcggtagtaatcgttttgcctgcacgccattgtatgaatctcgtgccaccccctttttaactccgagatacaactttccgtggggaaaagtaccgtagtattgtaatttcgagagcatctttacggtaattgcccctccacacccagacgttacacaacccttagtaaagagctgcggaaaaaaagtgtgccttcgcactgtacgactcctgattgattccctcattagcactgactggcttacgggcacataagttattaagggcagattaattcagtcgctgaataatcacgttgatgagcacgaatacctgaaacaccaacggtaatgaatcaattggcctagcgcatcgttgtgtgcttgggtgtgccgcacaatggcaaccaaatactgctcgttcctgcacttcgaaagaaaagcagccaaaagaaaacgcgttttcctttgcgagcgctggtttgttcctcagtttgatagaggcgttcaattggcaatttgacactaacaccgatgataacaagatatcttgactttgacctctgatattgaggcgttccaaccaataagaggggctgacggttgaaaataagggtaaaagagagctatccgggttgggtcgcagattaacttagaaaacatatacatgcaaatgttgttttttacgtacagaaagaggctgatggaaccaaaggaagcaataatttgcaccttggtattttgcactttctgcttttgaaaccttattttatgcctttacatatactgtcacgcgacattttcaccttctacagtgtttaatgaaaatctggcttgtgtgcattatcttttttgtgaaagtttatctccgcttaaacaaagcgattgaatcttgtctacgtaattgggctcgtgggacgaaaaggctactattttccaggaaattgaagactttgcaatcgtagcaaggtttctttcatcgttaacatacaatcatacatagagatatatgggcaaaaaccatttcttgaaggatttctctgctttaccggaggacgtactcatagaaaacgagagaggcataactttacttggttacccactattttctcccaagattttactgccccacgttgacccaccacaatttcaaagactaaacactgaaaatggctcgttaattgccctgtcgaaaaataccatatcgaacttcatagaactgtatcctatcgatctgagtactgaacgcactgcaggcagtagcagttcacagatgacaaagtggttcgtactgatggattacaaggaaaagtacgatattgacgatcaaggatggtgttatagctggaatttcaataactctaggtggaaatcgaaaaatggcttggtgagaagaagggtctgggtaagactacctacgaccagtcatggattagattagtaatagtttacgctaatattaaattgtttaacaaactaagtagtcaaaaaaaaaaaaaaaaaaaagaaaaaaggtgacattatgcagaacatattttatcgatccgcttatgtgcaccgctttcagtttgtccagctaggctagaatattatttattattaccattattattatattattattattattatcatcatcatcatgaacctgatgatccgaattgtgaagcccacttttcgtacttcactaatccgtcatgggatacagagggcttgatatactctaaactgttcttaaaatccacaaggcctatgggtcttatcatctccctctctgtttctaataacttatcacccagatctcgtagtgggcccatggcagcatccttcgctaaagacgttatatcacttcctgaatagccctcagtaatctttaccagttcatcaaaatctgattcggttaacgtgtgcttttgatgggaaagaagcttcttaaattgaacgtgtctggtctggtcctctggtaatgggatatattgtcttctcacaaatcttctccttgcagcctcatcaatagaccatggtaagtttgtcgcggcaagtaccagtacccttgtatcatcttcgtcgccattggtgtcagaattgttagtgttacttttgtttgaaccagccgctgcgctggacaaggatgaccactgaacaaggaattcattctttatccttcggcttgactcattttcattttcgttattcctactacccatgatagagtcaatttcatcaacaaatataatagaaggtgacaattttttggcaattgcaaatagtgccctcactaatttttcactttcacccaagtatttagatgtcaaactggaagcactaatagagaaaaaggtggagtgcgactctgtagctacagctctcgctagcattgttttacctgtacctggtggtccaaataagagcatccccctgactggttcacgtaaccccctgaataagtctggtctcaaaaacggatagacaactgcttctttcaaagaatattttgcactttctaaaccagcaatatcatcccaatgaacttcatctccgtgcactacgatttcggcaaaaatttgctttgcagcttgcctatctacaccttgtaaactatcaataatttcatcttctaaaatctccctcaggactttcttgtctatttcaggctcttctctttgctcatttagggaaatagcacgttcagtggcatcttctgttccaacatcttctatttttggagaaccgattttcttttgtgctggtatttttcgattcgttttactcatagacgtggtttgatttttcgatggcttcttattctgggatgcaccatgcgagtatggttttgagttacttacaggtctggaaggatggctactcgttttcttcgaactggaatttgggacttttgccgttttggatttcgaaatggggtgactcttcttcgtagtgtttaatgcggggttactcgcaacctttttgctgttcagaactctcttagcagccattgcagccgttttgggtttttgaattactgaatttggaacagtcagagaagaggtcggagacgatgcattggatttgatgattggttttgtattactttttgatcttgtaataaatgttggcgttgatttagtgataagagtgggcgttgatttggtaccctttaagtatggtacgtgattattcttcattaattttgatatttgaggattcctaatctttgatgaatccatagtaatagaagtttctaaactatgtggctttagagcgccagtgctggacgctctatcgacatttaataaaggaggtggaggtaatgaaggaagagcaggggcagtagtcggcagggactgtatgcatgatccgggaacattttctgaagaacttacactcttattactggacgtagaagaagtaacagacaagtcagacatttgctgttgaattgcttctaacgtttttatacgtcgtctttcctctttttcttcttcttcttcttcttctacgtcgacttcggagaaattatcatagtaatcggacacatcaaactcgaaaccatcactttcttcttcatcaaaaacgttgtgtccttttaaaatgccgacatcgtgatcatcctcgtcattagtcaaatctatcaatattggctctgagatatatttatctgagtacagttcagtttccttcttaagtgcaggatcattgtgctcaatagggttcttgtgctgtctgcttgcattgttggataaaggcttagaaggtacaaaatttactctaatgttctccgcatcttctccgcgttttatcgatgtgctgttaccatatgatgatagtgaggggttggagtatgcggttttatagccgcatgcatttctatttcttaatgttttcatcattcttccgggaaccatttggaatacaggaggtggttcagtagaccttgtgaaagatgagccatgattagtgtatgttttggatgacggcatatcattcctgggagcaggctcttctcggaccaattttttgactctttctaaatgcataacgctcttgtggtacaattctcgaataccgttctgtaaactaacttcatctttcgtgtatgattgagtatttgggtagttatgctctatcaatgtctgtttgaatagtacatcagtggtaagcgctttccatccttgcaatgcttctttatatcgttttttctcttctaggttcaagtaatatattgtctcattggcaattctactgtaaagttctgtaaagtcggttaacggttgttgaggtcttctccgtatcttggttaatctcgttaaaatatgatggcttctttgtgactccatagtgtcacagtgcgatataatcaatcctggtaaaaccggacgagtgaaagggaaagaaaaattgcgtttgttagctgcaataaacgtaaaaagactatatcaaaaaaagaactgcagcctttattattaccaatatatttgataagaaagtatatcggacgcgtattgtagttcttggggagccggttgctgttgcttcagcctcttatgactgtgaatcaagaatttttattattcttgatttcaattttctccgcgaatctcggctaagatgcttgggttgccagtgttaattccatatatatactgaataatagaaaataagttaaaacataagtgctcaagacttgaaaggttggtgtgagaaaatcccgtatgcctgtgatatgtctagaatacatagaattttttttcttcgctttgtaattgattgcgctatatatgaaaaatatacatgaggcgttattaacttgctgagcttatctggccacagtatgttttttgtgttccttctcctgctcacctaggattagctcttcaaaaactctagcttcttcagcttcttctggtgaccttctagcactggcaaacttgtgggcaataaacagcattgcttttgcctttgcaatacgttccttggaaggaacctttttatcgtttagaatcttattgcaaacgtcttttagttttctttccagttcaaatttcgacatagcccacatgacaccaagtgccttaccagccattgtggactcaaatttggcacgttcatattggtccagttcgtcagtattgacttcactcattttttccatggctttttgtgcttctaagcctgtagacaataaattgtatgctgatttaacagatctagcattgtcgcgtgtaccagtgaatattttagaaattccgtaagtcttcttggacatgataaaattattcgcttttgtcttgtaaaccctggccaataaatacaataactctagaccaaaactttctaatttcaaatcctcgatttcttgatctagttttcgcgtaaattcctccaagttattggacttcacagcaattaagtacctagagattttttcgttcagtttttctgccaactcgtcgacttgtttcatcatatcttcccgtctttttttctccatttccattagcttctctctttgctccttcgataatttatcttttttcaaagattcagctttattagtgtcatgcttaaccattccaccatcagtactctcatctgctttttcggtttcagtggctgctgtaccctcctcatcttcctttccaaacatttctgttgcctcgtttagctctttgaacaaagaaaattctccaatccaatctttgaagccatcaccaccgaatattgctgtaaagtattcagaagcatcttcaaatccttgctgaggaacagcatcctccttaccaaactggtcatacttggaacgaagccctggatcgcttaagacttggtaggcctcgcctacggcttgaaactttgcttgagcatctgggtcatcaggatgcttgtccggatgtgtttccatagcctttctacgataggcctttttgatttcagtgggcgtagcctcaggcttgatgcccaaaatatcataatactccgtctcctttaccatattccctcttttcttttcctttgagttaatacgtcttaattacgtgaagccgacaattatctaagttgctctttttacaggcgtaaaccattggaaagcaatggttacggctaaccgcggatccgactgtatcaccactttaacactttatcgtccctgtttgtccttggcagtgtacattcaccatcaaattttccgttctccgcccccatcttggtatgacgggcgaaaacaccgcagtgacgttcccagggtctgcaactgaagaataaaacaatccataggagaaccacttcgatttactgtcttacttctcgaatacgaaattattttggattaatcatcattgtttatttctgaaacgctaaccgaaagtctttatcatttgatttgactctagcagatattctccaggaaatgttagaatgtccggtaattccgtttgctatattctatttgttgatactgatgagcatcaaaaaattatgtaataagggtatcaattcgcattcttatgtttaatacatacccagttgtttgtagctggtgcatatttagcggcaattctctgttgcgtaaatgaaaatattaatgtaaacaaaaaaagaccaaagcattttagcagtgtaagaaggtgtactgatacaaaatgtgtttagagtctactgatatgttactggccgttcgttgggaaaaaatgctgtatcatttattaatcaaaagcgacttttggtggaatattatgatatgtgttgttaaaatatgacgtaattttagaattgtctgattcgtattcaaatttggtgaaggaataacgcagagttgacaatctaatagaatggattaatcgtaattttcagaaacgtagaaaaagaaaaacaattaaaacattatgtaagattattgatttgccttttaagggtccatactcctgggagagaacattcaggataatatatatacctgagaaactggcgaataatttgataattgttcggattgcattgttgccaaatcctataacattaggtacacatagtatacaagcaattctccccgacgttataggaattcacaaaagagaatcgatagtgttactttatcttccttcctgttatactttgtctttcattatcctattagattacatttcagtttccatcaatttttatggctgtctctcaatttatgttatcttcttacaccgtatatgatggtatactagtttacaatattagacgatggatgatgattggttcttatcataatttgatttcggcagaagcaatattagaggtattgttgtaacgaaattccaatgtcatctgcttagtattattaatgttacctgcatattatcacatgccgcttaaaaatgtgttataagtattaaaatctagtgaaagttgaaatgtaatctaataggataatgaaacatatgaaacggaatgaggaataatcgttgtattactatgtagagatatcgatttcattttgaggattcctatattcttggggagaacttctactatattctgtatacatgatataatagcctttaccaacaatggaatgccaacaattatcgaattattcaccagtttctcaggtataccttgtataccttgtatacctaatatcttgtatacctgatatcataatgttcaataacagtaaagtgctaataattatgtatttatttgccgatttttcaatatttcacctgtttatcggtgtcaaagtactacattcagtttactgtaggattagttgattatttttcggctaaatttacagttgtactggtcctatagtgtagtggttatcactttcggttttgatccggacaaccccggttcgaatccgggtaggaccttttttattcatttttacataatatatgccgaatatattggttaaagaggtttttttagttcccaaatgtccacagtaaagtagataaagcaatagctatttccatcaaatccaaacaatattgtattacccacttattattattaaacaatgcttttattggagaaacacccgctttccgggtaatagcagtatatttattctcattcatttataagcagcggagaaaaatgattgaggaattgatataactacacagtaactttacggagcctaaggtaacaagtgaagtttggatagcagttttattcccatttttatctgcagtatagggaactcggaatcaccttttgaaagaagagaaatgcctggatttacagctccaacaagaaggcaggtgttgtctttatacaaggaattcatcaagaatgctaatcaattcaataattacaacttcagggaatactttttaagtaaaacaaggactactttcagaaagaacatgaatcagcaagacccaaaagtgttaatgaacctatttaaggaagctaagaacgacttaggtgtcttgaaaagacagtctgttatttctcagatgtacacatttgacaggctggtcgtagaaccattgcaaggaagaaaacactaaaacgtggcctaactggtcattgcatgtaagaaaaaactttccagtaattttttccttctcacgtcaggaaattcgtatggttatatcttatagagaggtggccgcctttaatttggaaaagatattattagatgatattcctaattttcgaccgatactttgcatggttggacttcaattagatcatgtaatttacttccttaatatcaatagcatttcttttttggtagaagatttttcttttcttttcttttcttcaacccatatgggactataggaggagagtttatagcttgtatataaaacactataactaaaatataagcccactctgaggtgagatgtctttacggtatgacaacaagctgatgcaatgagagatcctatgaattgcttggattcttttacatcaggcataaagtttccgaagtatgcaataaaatgagtatttgcttatttattgtttgtatcgggcgatcttacacctactttatgtgcgtaatagttgcatcttcttttttcggaccattccatcggataaacttcttaggtaaaagtgaaaaaaaaaaaattcgcctatatattaatcaagtcatcacttggaagccgttctcttccgtttacaacacgaagagccaactgttttcttgtgtcattctttagcactctttctttttatttttacattttttaattaagatcaccaaatataccggaaatataatgaagagaaaaactgctgaagttaaaggtgagaaggagagaaattccaaacaaatttcgctcgaagaggacaagataaagggtatgttcaaccctaaaatctgggacaagactttccaggatggcttgaaaaaggaaattgaagactctcagccttacaactggggtactattcatgaattggttaatgacgatctactacgtgctgttcgtaaagaaatagaaactgagatccatttcaccaaaaaagaaaccgatatctatagagtcaaccaaagtggtgacttggccaatttgtctggtctggactgggatgacttgtcccgtttgcctaatttgttcaaactgcgccagattctgtattccaagcaatatagagatttttttggctacgtcaccaaagctggtaaattgtctggttctaagaccgacatgagcatcaacacttacacaaagggatgtcacttgttgactcatgatgacgttattggctctagaaggattagtttcattttatacctaccagatcccgacagaaaatggaaatcgcattatggtggtggtctaagactttttccaagtattttaccaaacgttccacattccgatccatctgctaaactagttccacagttcaatcaaattgcttttttcaaagttttaccgggtttctctttccacgatgtcgaagaagtcaaagttgataagcacagattatctattcaaggatggtaccatattccacaagttggcgaagaaggttacatacctggtgaagaagaagcgtgggtccgtaacaacacatccactttggcgcagattgaatctaatgtcctagaagattttgaatttccaaaggatgagagaaatattttatcatttcatgaagtgaagcactttgaaaaaatgctcaaaggcgatgctggcgcgaaaactgataacacacctaaagaatctatgactagtgtgatttctgattcggttaagttgtctgaagccgagttcacctatctatctcaatacatctctcctgaacatttaagctcgaaaggtatcgaaaaactacaaaagcagtttgttgagaactcttctctacaaattgagtcgtttttaaatgacgataaatcagaattgttaaagaaggttatcaaacaaaaagagttggaacaggaatgtccttatcattcaaaagatgtgaaagctccgtggaaaacggctattcctccacacaaagcccgttatttgtacatcgacggtaaggaataccgtaatttccaaacagaagctgatattcttgaggcgctgaataacaatgatttgccaaactttcagtttactaaggatgcaattaaaattatctccgatgcttccggaaatagtagggaaaacaattttgatgcagaattagcgttgattgacctagctgtatttcacaagagcacaattttcaagaaatacctagcccttctaacttctttgtgcccagtcagtgagcaaatccttattagaaggtttaggccaggaatggatttcacattggccaccaaatgtcgctttaatgaacttttgaaaagcaatccagatataatcgatgctgtcttggaaggtactttgtgcttgacaccttctgccggttgggaatccggagaacttggtggttacgaattgtacatgatggacgacgacgaagataataagcaatacttaaaggaagacgttgaagacgcttctgtttatcgtgcggatgacagtggtgattcagtattgattaatgatccacctgcttggaatactttcaatttggtcttgagagatgaaagtgttttggagtttgttaagtacgtcagctggagcgctaaatctagtagatgggatgtcaaaatgaagtgggatgtcaaatcatgtgatgaagatgatcaggaagatgaagcgtaaacaattaacccgtcttattaagtaaatggcagcttagatatttataaagttgtataatagaagtaataaaattatttgaaaagttattcgtcaatttcagcttattcctctggcgtgaatatcattaccataatccaaattcgagtaagcgaataaaacgggtatattaaagaaatataagaatgaatataagtttaacttaagatctaattgcgattctttttacatattgtatatttacagacagaactatgaaagggccttattctcttaattatttcatgtggagaagcattagtgtagtacagttcacattaatcctattgcctggcaccgtctaatggctttcgatagtcttcgttgattctttgccgataagcctgtgatatccctatgttggattcttcccgtggaggtcacataccttgaaagtattcttggtcttgcataaaattctagtggatttgcaccggacttcattatatcgttcctgtttgagttcttgtttgcctgatattttctatctaaatggattcgtcccaaagagaagtcaaatggatcgtagatagtacctttgggaagttttttggacaaagactgatcgattttcttagtttgttgcgttctccccatttcaatattgacactcttcttttctttgataccgaaattgtatagagcacgtttaaatgtggagcttactgctcccttgatgataggttgcataccattttgaatttttatgcctgtggtggcattcatcttgaacatccgaagttttgtgtagaaccttgcctttttggttagaaactgtaacactgttaataatggactcatatttaagtatgtaaagtaatcctagatattttttcccccaacaggttaccctacaatgcaatttaaaggcataatagaacatctaatagaaatgggtgattataatgagtaagaagacgtaatgatcataaaacaaaatactaataagctatgttgcaatgcaagatcctaatatttgccagcattgccagtttaaagataatccaggcgcattaatttgggtgaagtgtgatagttgcccgcagtgggtccacgtaaaatgcgtgcctttgaaacgcattcactattcaaatcttacaagttctgaagttctgtcttatccaaattctgcgaagcaaattaagagctaccgttgtcctaatcataaggaaggagaatatcttaccgcatacgctctcatcacacaaaaaggaaagcggcaaaggaataaagaaaaccctgaagatagtcatataaataagcggtataatttcagaaagaagaaattacttgactatatcgctttgaatgagggtgaatcgaaaagggataaaatgaatcaccctcataaggagagtttcatgaaatcttttgaaaaatggaaaaatggctcaaatattataaacgccgctgactttgctgacaagtttgataatatagatgtgccgtacaagatcatcgatccactgaatagcggagtatatgtaccgaatgtgggcacagacaatggatgcctcacagttaattatatcaccgaaatgataggcgaggattatcatgttgatgtaatggacgttcaatcacaaatgaatgaaaattggaacttgggatcttggaatgaatattttacaaatactgaaccagacaagagggatcgaataaggaatgttatatcattagaagtctctaatattgagggattagaactagagaggcctactgcagttaggcagaatgatcttgttgataaaatttggagtttcaatggacatttagaaaaagtcaatggggagaaggcggaggagagtgaccccaagccaaaagtgaccaaatatattttgatgtctgtaaaggatgcttatacggattttcatttggattttgccggtacctctgtttattataacgttatctcaggacagaagaagtttttattatttccacctacccaatcaaacatagataagtatattgagtggtctttaaaagaagaccaaaatagtgtcttcctcggtgatattcttgaggatggtattgcgatggaattagatgctggtgatttgtttatgattccagctggatatattcatgcagtttatacaccagtagactctttggtatttggaggcaactttttaaccatccgtgatttggagacacaccttaaaattgtggaaattgaaaagttaacaaaggttcctagaagatttaccttcccgaagtttgatcaagtgatgggtaaattatgcgagtatcttgcgcttgataaaaataaaatcactagtgatgtcagtgatggggatttgctttccaggaccactaattgcgcaattcagtcacttcatgcataccttataaaacctgaagttaagtacaagccgttaaatttcacttcaaagaagcatttagcgaaagctttagccgatcttatttcgtaaaatttcttcttgtccgccacgttcctgtatcttttatttcatcctatgctctcgatgaatgagatctactttagcaattgatacagtataaccctgacattacatttagggaataatcgccccaatataggttacaaaacattaatatatatgtaaatatatgtgcgcgtatatatatatataaagggaaaattaatattctatcattaaagtgaagaagaaaggtggatttaaattccaagtcttttcaattgttctaaacgttcatcaatggcatgttcaaattggtttgaagtatttgtccgctcacttagtaacttggcatgaatacattgtagcgcttttatggagtcagattcattgataacgcaggatatgtttatttcatttgccccttgagaaatcatttcaatgttgatgccttcttcagcaagagtagtaaacatggtaccagcaatgccgatgtattgtttcatatgtttaccaactaatgaaacaatagacaacttctttgtgatatcaacagaacctaaaattctcaatttttcctcagcttgtctcagagattttaatgagtctgcatctggaatgggcaaagccatcgaaacatgaacttcagaagtagatattaaatctacgactaacttgtacttatccaggatggtgaatatttgagctaggaaaccatgggatagggttttcttattggaatgaatgttgatgacgaaaatgtcatttttggtggtgatagcagtggcacctctctttctcttttcatagaaagatgaggataagttctcaggaggatgtggtggagtagattcacccttctttgctacattatctgggtagataatggtaccgttacctaatggattttgaacattcttgattctaataggaatcttagccctaataacttgttccatcgtaaaaggatgtataacttcggaaccataatatgttaattcagaagcttcttctggagtaacactgtctagcaaacgtgcttcaggaaccttacgaggatcagcagtaaatataccatcaacttccttccaaacttgtagttcatcagcatttacagcaactgctatcaaagcggcacataaatcggtatagccacgaccaacaccattcagaagaccagttggaactaaaccaaaaaaccctgtaaagactggaacgatacgctctttagcacttacaaagggggccaatttttctttcaatgcttgaaccaggaaagtgtagaaactgttatccaaagcgctggcactgaaatcagagggaacaatgtggctcaaatccacatatttggccttacagccacggtcattacataaagcagtcatgaacaaacaactcaacttctcaccacatgacatcaccagatctactgtacgtgaactcacttcacccaaaacttttgaagcatttaaatatttcttgaccagttcaagttctttattggtatcatccactaacttggcttgcaaggcaggattgagaatgaagcggtcggcattatcgatatggtcttgtctgataacttcgataatgtcttgaaattcagattcttgcgaagccaaatcacaacatttcaaaagacgagaagtggtaccttcagccttggtgtatgaagaacgggcggaacaaacgacagcgacattattgtttgggccgtcaggtttagaatagtgcttcacaatgtcatccactatttggacgggaaatttaccgacagatgtaccaccgaacttttgcacgacccagttcgaatgacttgatgtaggttggaaatccattggcatgtaaaagttaaaaaaaatgaaagcttctgtgataaaatgcgatagctatgtgagcttaagcgatggagagagtattggctacacaaatatccttcaatgagtagagcactgttaaaatagaaataaaataattatccagcagtattcttatatatggatattatacattatttcttcgaagctaaaagaatctctggagaagactgcgtacggaaagtgaaaaaaaaaaaagtgatgatgaaattttcgtttgctagtgaaaaagaaagaaaaggtgagtcatgggcctgaaaaatacacgtggttagagccacagtagagtaaaaagttgatattaggggagttctagaaagaaaaggatcctgtgagaccaatgacagtgattgtaaattgtgggagtggtatttgatgttactatcaaataaggcctcagcctctgaatatgttcacctaaaaattgtagaagattcaatcgcgagcggctggcaagtttgggcatgcatcgagtattgccgtatatcgaaactactttataaatgtgtttctgatatggcactttcaaagttttccttggcctgttcttggcttgagagatttggcaatcataacaaaactcttagtatgaaaagaaattgtaggacgaatatttattaagacatatgcaaagaagaacaaactataaatgccggtcatttactaactttataaaatcctgtgtatacaatattcctctagcacagagtgtttacgataaaccttgccgattgaatcgatcagctaaccggtggttggtaagcctacataagccttgaacgaatcgtaaattagccattggaaacttgtcaaagtaccgatcatgacaattctcaccattaacccattccacaacccagtaaagccaattttttgatatattcttttagaggctacagacatggactcgttggcctttctttcgctattgatcttggaaaccataacgtctgcaggatgtgagactgcagcacataatatacctgccagataaccacctacaaaactgactgatatttgctgtaatgcgttcatttcttctttctttttaggtaaaacactgtatattttttgaacaattttttcgaatgaggtaaacttacacattgtgtaaggaatctgtctgcaccataggggaacaatacctttataaaatgctttcatacctccactttctgcatacatttttttccatccatcaacaacgttattgcaaaagggcggcatagtagtctgctgtttcactttaatagcttcaaatgggcacaacatgatatcagcgaggaattcagcggtcgctgaggccatcaggtacacagtgacaccaggacttaaccaactagaatacaaatgcttgaaatactcataaccaccatacttacctgcaccttgtagcgaatatccgacgaatgtagcaccaaacccagtgtatactttcttccagccttcattagctataatcttacggaacccttgtaagtttgaagtatacaacttgggattgacctgtagcctacatttgacaagatctagtggagtgatcgaagaatgtgtcggaccgcacgcaattataccacctaaggtacatgtggcataaaactctttcgtatataattggattttacgtggttgtttattggactccatgctttacaactgtcaatgagtccgttctctttttcccttactttatttttttagaattaaaacaataacagaacactttcagttaacaatgtgtcattgactgcctggaaaaaaaataaaaaatctataaaacacaagcaaaataaaagtatatttggtaggtcccgctgtatttatatcaaatgtaacagggtatgcagaaaatcgatatatccattttcctttttattaagcaaaatgaaactaaaaacaaggaataaacctaaaaaagatctccttatttcgctaatacccctgaagtccaacttttggttagccgagatcttagccgaatgagattgtccaatgcttgaaatgcaacccaaagtgaccgttgttgctagctagcatatgaatgaatctaagaactggaaaggcaagttgagggccaaaaataatgacttgaacattttgcagtatctacgttgaattaaactattcttcgtaagtggtacctttcacttgctacttgtcaccttattacctatgtgctgagagggtaatggtacggatgttcctttttgacacaatgcgtcttttccctatgctgtaacaaaaaaaacaaaggccgaggttcggatttcttagcagatcacgtgttgactttttggaatacaccgttaaaattctcacacggttagtatttacattttttcaggaatagggttttgccgcttaccttgatatgcgggcgattttgcgggatttctgacatctaataacttagtagtcattgaaggaacaaagttttagtcttattcggatgtttcccttcttattttcgaaatgaagctttttggagagatggggataggtggctttttgtgccttcctcgaatgtttagccgagtcttgcgatggaagggctagacagcatgttttagagatgtagtaagttatattataatcatattataattgcctaaatatagacgtatatcatatacaatagcaaaaatacataattacgaacataaaaatgaaaataactttggtcaaacagcgcgagctgtcaaacgtataaatcttaaaaaaacgtgtattaagtatgagctaagaaggcgcccatcaatagaaaaccggattaaaaacatcgaaaattattgaaaaaatattaagtgtagtgtggaaatgaatgagtagaaaaaagataaattagaaaacagaacatcaacttcgtaaatagtaaaacgctaagccagactaggtagaactgactttgcatacctctcttggtggcagtaagcagattagctgatttaaatcactgcaagtaaggaacatcgctcttgtttctgttcatgactgttctatgagcaccaaagtagaaaacgaaaatgaaagcgaaaatactcaaaaaaatctctaaatcttgcattgtagtgtgtactgtatagtaaagctattgtttgtttttattatttctatgtagaattctgtaaaaggacgaaaagaatgtttccaagcagtatgtctacctctgtcgttgtagaagggattcctacttctttatatacaaaatgctcatcggtagaaatatctaattctctatttaattgaatgcataaggggtaccaaaaaatctctcttcacgtcttatagctgaacagttatcggatataggctaccatataaaagaacagggatgtcctaatacagcaatctttttttttccttacgtaaaaagtaaagtaaaccatccattctcccttctttcagtcaaatgccgcagtcccttacatttcaaactgaagcgtcgggatgagactgtagaaagaagtaggagtagtaagaacaaaaaaaaaaaaaaaaaaataaaaatataacctctgccggaagtgaaggcacaaaaatagctctctctaaatgggcggtggaagggtgttcaaaagtaaagaaatataggcgcacttctgaagtcatcgtaggtgaataagcaagtctttatcggcatgttcggggtttttttttaccaatgacgatttctgtcacttaactttttaggccttccgtggtcgtgtcatagcaacccctagttttctcttcacattttgtcgcgtttccgtcgcacagtaagagctgtatagcgttgaatgaatgtaaaaaatgctcactgaaggacagtagcctttaccagtctttacgtgccgaatgcacatttgtatatacgcccacacacatcgaagatcggctcccgatttcttgtgagatatttatctgtttatttgcttatttgtgatttatgtatatttacttgaaatattctagcatgttttagagttatttatcggagttcggttccaatcatgagagtaactcaggccaagatctagcaagtcattttgctttttatgtccgttcttcatcaccttccttttggttgccttcatgctgccgccgcgaagggatcgttaaagccatccattacaacatccaccttataattattcccgttgttgttgtcccagtactcttcgcgctcatagtcgttacgtgtagaataatgaatgcaaaattctaacttgccgcgaggatccactttgctggcatcatcgataatgaagtggaaaatgtccatgttagtgcccggcaatattccatcgccatcactgatgtaaacgcattccacttcatgtgttgttctccaactatcccacgtatatcgtaccaccactcttttatcatagaaaatgtttttcactagtatccttccagcaattaatcttgtacagccagcgttataacccttggccacaccattacagtcattaccattgtggctattgggaatattattaaatgaggaggaatttgaaaagtaattgttgtctctatggatgtataatgacaattcttgtagaaaaactttcttattttgtgataaattgataaaaatgttcagctttaaacttttaggattcttgttgcttaaaatggggaagttcttgctgtataatccaacaacatggtaattttttgaattacgatctgaaatttcatgagcaccgccaccattaacgaattttttatttgattttgatggtggcatgtcggtcctgttctttaggaggttctgaaatcttttactttttcttaattttgtattgttggtgcctttaccattgtttggactcgaaattttagcaggatgtgcgaagccttttggcgcaactgtcgtcaagtcatcatctatggatgtcgtttctaatccggatgatagcatttttgtctcttcttccgggtccaccattaaattcactggcttatgcttaaagcttagacaattatcgtgttgttcagttttattaacgtttatagggctttcatcctcagcaaaatattttacaggtgccgcctgatcaaagtgaacactcttactcctaatcaacatcggactaccgtctcttgcttggacaccattcccgctccttatacctggggttgtaggtaatgattttgatcttctcttcaatgagctcttcaatagttcacctgactttttatatacaggtggcgcaaatggaattagaatttcttcatcatattcaaaattcatatcattgccaggtgacttagcttcgggatattctgcttgaaaagattttggtacggtggatttgggggaaaggggaggcagctctattttgaatgggggtctcgtactgccatttaatgattctacggaagtgtgattcttggcagcggcaatttttgaccagcagctctcattatcaacgttttcatcattccctgcggagaaaattcttttgtttaaatcagtgtttctttgcacttcttcctctgggaacctgttcgctctcatttgagttactctctgaggtttatgtaaaaacttcaaagagtttaaagtctcttccgtactcccatctcgttctttgttgtataggtccgaattcactctgtaacccttgaaatctgtttcaagatctggtagctgctggtttttttttctgtctagtttttcattcttcctctcaaactgttggggtttctgttctgcctttatatacattgttgcgttgatgaaatcctaataaacttgggctgtaagaataaaattttacaagatatctgtacccgttcctattaaacttgtttctgagtacaacggagatctttttgatgttcagcctactaaaaactataccttacagaaagaaaaaaaaaagtccaatgtggttcctttctcctcaatcaaacagaatgccaaccttccttgtttcttttccttttttactactaaaaggttttataaaccagacttctctctttaaacgtcccgtcaaccctgcctttagtaactgttttcccgtctagctttcttttcgttcctattgttttaaccgtattgtatgcaggtttaccttctataaatatgcactgaactggaaaggctatgtttgaaaagctttagtttccttctgttgaacggatgggccctgtgttgcttattacgcaatgcagtatatataaaggaactcaacctgaagaagaatatgcaagatatagaaagaccgttgcaatatcgaaatatttcctgttggatagaacgaacttcttggccccttcattgagaagcgtagctgatacacatttttggtaaaagacctcatggtagcagcccctttccccttaaaaagacttaatatggcatactgtttttcttttatgcgcttcattccacggcaaaaagaacctttccccgcccccactctgcgacaggagtttgccgcccatctccacaataggcatagttgtcggtaccttccagcgctatgtcagcctcttccaggcaaaaaatcgacgtagcatggaaaaatgcattctagacagcattatgcgttacgatccccaatctatgctccctggggagagtttgtacaggttttctccaaaataaaaaatacctacaaaactccgaatatttatgggtagctccagttttcgaaaattggagaaatgaagggggttgaagaagaagatttcatgagcatgaagacggtagtaaagctgacaaatatgctacgaagatttaacttcctggggaagtatcaaaaaaaaagaaaaaatattcacagagataacctcaaaacacacttgggaagtcatgaggggtaacttagaataagatagaactctatcaaattattgcctataaaaaattacaaaattaatcgggatttggcttccctttttctgttctatcttatacacgacaattagaaatttcgaaaaccatgatatcagatgcgccgagtcttttcaattcatctaaaacaacacccttcgtttttctctcaatcatggaactaacagcaacccatccttcatcgtcaattttggaaatggttggtgctctacggccaggcgtcaccttcaacagttcaggcagcttgtcttcaggtgcgttataaatacatgaaacgaacctttgagcggtcatgacaccttcaattcttgatttgatagtagcaatcaaactcttatcgctctttgggttctttgattctattaggtaggcacttgtgcttaggacggtggcaatatcaactaaacctgctgccctcattgtctcaccactctctacaagatctacaatagcatcaccaattcccagagcacatgatgcctccacggaaccactgacaaactttatccttgtggtcattttttcaacagtagtaccttccaaatcggcaaagtatttttcagcaagtttcacgaaactggtaacaatggttttgccaattaactgttctggctttttatactcgccatttacggggacttgtacctgcaatttacagttaccaaattgcaaatcgattgctaagtctacgtcgacgtcagattcacgaacttggtcaacaccagttataccaagatcacatttaccttcaccaacaaaagttggaatatctgcagcgggcagaaagatcaacgctacaggtaagcttgtgcttagtgcaatgtctaatctttgagagcggtgaaatgtaatatcagcaccattcaaaatagaaacacttttagaatataaacgacctttctttgggattgcaaacagtagtctatcggttagatggttcaccaaatccatttttctattgaattttttagaaatctatcctttcttttctattttcaaagattcaaaccgttaataggagtaaaatgccaacgtttagacagtaaatacttgcagttcactgcgtataaatggactttcaggcgagtatattctgcaaaaacattttataagttccaacggtagaggtgactcacttggaagctttttttttcaatcgtcggctacgtgcgtacacgtgttttgcggtctcgcttcgaaatgccgaaatgaaagaatttccgggaagagtcacgctgttatcaatgactttgcaactaataaattaactaataaatattttaattaattttttgacaaggagtctaatacctcgcatgctaaacaacctctctagccgggttgccgggttacatctcgttctctttacgttcacatagtcatataaccactagtcacctgtgcattcttactttttttttctttttggtttttattgtaagactgatatgcaggccacaaagtctcaattaggtcgcagccgtgcaaattgtcttggcatttttgaagttttgtatataccatagagattatctttgatatgttattaatattgtaaaatacagtttgtagctattgtttattaaatgagatgtctaaatagtttacatgaaattgcatctatgatacatgacgtgaaatgtgtacggggaaatgatcgccctaatcattacttcctaacgaccgaagtatttcaattctaaaggtcttaagatattgtagatgatgaaggcccaacttgcacccaactcgaacccaatgtcaccaccatattcaccaattaagcggccaatttcaccaacccaataggtttgacacatacccaatgcaacaccgaaggcaccaacaattaaggcagcagtacctgcaatgccgatgggtagatgatcccaattatcccaatcatcaatattgtaagcactgaaggaacgtctgtagaagaaatgttctgaacatgagatggcaatgtaaatagctaggtagtaaccgatagaatccataaaattctccataaagccatcaaagtaataggtagcagggatggaaatacctaaagtggcagcattacctgccattgtccagactactcttggtattttagccaaaggtgcccacaaagcttgagcggataaagcaacagtatacatatttggaatgttatttgcaatagtggacagagctaacaaaacgcagcagaattgaccaaatccgttcagagagttaggaaccaggatagcatatatgacaccacccatggcgtttttatcataatatgccttccaggttgggtcattaagagcaaccatagcagaagcagcaccaagaatcatggtgaaaaatagagggaacgctagaccagcaactagggagaaaaaaatcttgtacttgtttgtactctttggcatataaacagtgtagtcagctgcataggttgtccatcctgcggcaaaaccgaaaatagatgaaccaaaagaaagaacaccacctgcagtagttgcacctcctacccattcaccacctttaaactttcctgatctcgatagttgggcaataataaccaaaaagacggcaaaattgggtacccatgaccatttctcgtatgcatgaatgacactgtaaccaaaaaaagtcacaagcacggtaccaccaataatgatcagacaaccggcccaaataggacagacgtggccggagccttcattcaccatattcagcagttgtgcggatactgaggtattcacaataccccaaccgacacaagcaataacgttaataagagagaaaattcttgccgttacattaccaaccagatatcttgataaaatcatctgtcttaaacccagttctgcaccaaagacagaaaagaacgcaacaaatatcaaccccattatattgaaaaatatgataactaaaacactttgaccaaaatttagaccgaacaccatgggtcctaaggcacccaaagcatatgatgcaatgaccatattagctgaaaaccacatggacgcagcattcagtatggaatcgtccgttttttcatcctctgtaactggttcaacaccctttgtttctgcattcaaactggcaaagaacttatggaaccacgataattttgtggcctctgatgattcaacgatatactgttggtcatcttcggaagttgctgtgaaagtttcagaagcggctaccttcttttcgttttccaagcttgagcctattacaggagatctcttctccaagtcttggatttcgtaaacattatttccctcttccaacattcttataaatcgttataatagaggataggatgttttatatgcgaaatttatatggatattgttgtgaatactattacagttaagcttacttatctacatttcaaagaaaaatgcctctaacgcgttttagactcaccactattttactgtctaaatatttttaatggatatttatattaaaaccattatcttggttggttccctaacatcttgatcatcgagaaaaaaaaaaaaaaggacatgaaaaattctgacaatgaaaaaaaagaaattaaagactcataattatttattgataaggcgaagacatagcaactatatgtacgtagaagtcaatggcaatcgcgataaagctgtgcattaatgaccgaacgcgggcggcagacatttctgaaaaagagtcaatttgtacgaatacgccccccactcgggaaaggcgataaaatcgactgatatttagttccttgaggccgttccattgatgacaaaagaaaacatgccgctcgattttctaacactaagcaaatccgcagaggagtattgcagtcactttgaccgaataagaccagtatccatcgattttctgtcttggatgacttctttgctgttctccacaggtaaatcacttaaaaaagatatgagatacgttagattaattaatttcagaaattaatatgattacggaaacttggttgaaagtggctgaatttacgacgtaatctgtcttgacatcttttttttttttcagcgagcattctctaggattttttgtttactttccacttggattttatctgtaggctttatcaagttcctgtatgtatggttgtgcaaggcactcttcttcataaaggaaaagatgtgctgagatttgtaaggcttttcatcagtgttagatctgaggtggtgttcacattaacttaatcgacgcaggatttggcggaagcttttggcataatgtctggtgtttgtggtgtgtgattttttttttgaatttttcttttgctcttttattcccatacattgaattgttcgtggcacatgaaaaaaaaaataaaatatgaacaggtcttttttatagcagagttacgtcgtctacagttggacaagcgattgactaccaaattcccatggctatggatgacgatgattaatgaagaaatagtagctcgacaacattacaaaaagcattattcatagagcgctagagccatgaaagttttcttgtgatatgaattatttttattcgtgctttatataaaacagttaattaggtacataagaaaagtgacattttcttaaagtttatttcttagccttcttttcagatttcttggcagcttcggtttgttccttgacaaccttcttgacaattttttgttcttcgatcaagaaagctctaataattctttccttaacacagttggcacatctggaaccaccgtaagctctggaaacagtcttgtgggtcttggaaacagtggcgtattgtcttggtctcaaagtagagataccttgcaaagcgctaccacagtcaccacactttggtctggtagctaacttcttgacatgttgggcacgcaaaataccacctggggtcttaacaaccttgattttgttagaacgggtgttgtctatttgaaaatgttttcagaaagttggtatactttctcatttgaaaaatatgttagtacgaaatgtttcaataggaaggagttcgagaaaactttaaaagaaattttcgtaacacagattgagattattagctctagtcagtatcagggttaaaagtggctgctcttattaactatcgtttttcttctcattgctactaatattgtattatttctggacacaatatttcacgcagaataagttattgatagtggattacaaaaacggggtaaattgcttttgataactatactaggtcccctgacatggtatcctctccactcttgctcttttttagttgaataatcatcatctcgtcagaatttctcgtaatttataagtgtgcctttaacatacatggatttcttcttctgaaagtaacacgttgggccatctttggttgttctgttatgcagtctactcgttaataccgtttaacactaagcgtaattaatctataatatttcaattccttctagataatatcctctgcgcctaggctcacgaaattacacggaggaagcgtcgaccaggcgactcgttggtaggggaccaagcgcgagtaactaccagaatcgccttggctcagtagaaaatgacggcctaaagggaacctagcgggggagcgtagtcgtaagcgggaacagcgaaagtcaagcttctttttttttcaaaatatacggaaaaaaatttatcacccatacataccactaaatgtgttatatatttgagaacacctttacatcctaatgtttaatggaaaaaacagtcctcgaagagcatcgtatttgtagaaggaaccaagtaaattagtatacaatgtacaatgtacattcttcagatgggaaggtgatgaaagtcatacttctatgggctttatattataaagctaaaaaatacgtagtaaaatcctaagttctaaaagacgctattaagacttgcccttaatctctttcggcagcaatggcttccatttccatgtcaacgcctaatggcaatgctgcaacagcaacgcatgatctggcaggtttgtgagtattgaagtacttggcgtaaacggagttaaactcagcaaagtgattgatatctgccaagaaaatgttaacttttacgaccctgtccaatgaggaattgcttgcttctagaacattcttaatgttttgaatcacctgttcagccttatcagcaatggaaccttcaactaacttgttgtctggggtcactggaatttggccagaaaggaaaatcaaattgttcactttcatggcatgggagtatgaagccgcagcagctggagcggattcacaaataacgggagttagcgtggtgaccataattctaaagtaatgatgatgttcgaagggtaaattttctttcgcttttttgtggaaaccaaatatcaaagttgtcccttatcatgtacccgtttgataatgaagtaaattagtatttcttttgtaggtcagcagctcgcgctatggagaaaggagttataatgaaaccacgtgagcacgatgaaatagcaacatgttactattggacaccggattagaatggttaaaatggtgaaataaaaagaataattattgtgtgctcagtatcggttgaaaccactaattttggcgcttgactccactcgtgagtcatgtttggactatatatgtgccttgaatatatataaatatatatattgctatatgatcccgctgtttccaagagtagtaattactagacggctgttggcatacgtcaatgagagattagtgtactcttcgtaccatcaatccgcccataatcttctaagtgatcttccgatcgtatccatcgaactttactaaaggctcttttcggggttacccctaaattttcagtatttgatttgtattaatgtttagcattcaagtagtcgtggtaaacggacacatttgacattcaacgacggtacacacggtaggagacgtcaatttcggctgagatgagtagggctagcaagataacgtttgcagcttcctgtctgataacggcagcgacggtagtgggcgtgcattatgtgcaagaaatggaaagggaaactttgcatcagggtccgataaaagatgctaaacgagtcgaagaaaagaggttgagaaagacaaacggagctgcatcattagatcccacaaaagaaaggaaaaggtacttcaatatgagtgaacacgaggaacaaaaagagttgcgaaagaagtatgagactatgcaaccgcttagtggagaagttgtgaccaaagatggagaggtggttaaagaatctaagaaataaacacctgtcggcagtagtttacctctctattatggactactcttgtttgtatatatgtaagaatcgtgtaattatttccaagaagccttcaaattgaaggaataatctaaaactcgaataatatcaatgttaatcaataactataatcaagaccttaatgtgccagcctgcccctttggggattttacctctattttgaaattccattcaatcaatctctcgacgatctctaaggtaagatctcgccttgatgtggctctttttcttccgcccttgcggaaaaaatctgaatgaacgtaatttacctaagaaataacaaggctaaccttgatagaaccttaaaaaacagtattggtaattgcaatagcaccaaccgtaagtgagctaaactagtgaaagattttctaaatcataacgcgcggaattccagttaatatattacgtagtcatccctcatcatagaactgttttttttttgtcaaagtattgaaccagttattagttaagttaattgtagcaaatagcgccggtatgtctatcaaaggtgattccccctcatcaacaaatgccagtagtagtccgaagtctacatattcaatacaatcggatgataaagtaaaccttggcagtggtaacgtcgatatacgtacagataattcacaacaggacagtaataatagacgcgatattgtggtagtgacgagagtagcttctgaagagactttagaatcacaatcatctacttcatcaatgggaattagaccagaatcatcttttaactatgaggatgcttctaaccaagctagggtcgaaatgaataacagggtacatggctcaaatatgaacacaattaacaaatattatccagtacgattcccaaagaataacgaaaggcaattgagcgacacaaataatttaaatgagaaagtgcaaggcacacatacagttcaatcatccacccaggaagacaaaatactcgacggtgacacaagcaactcacaagtaaccccgtctttgaacattgcagagtttcccacagacaagcttcttaaaatgctgacagcgttactaactaaaattattaagtcaaatgataggacggcagcgacaaatcctagtttgacacaagagattgagaatggtaggtgtcttgctttaagtgacaatgaaaagaaatacttaagccccgttctggggtttagagggaagcacgtaccacaaattggtcttgaccaatatttccagaggatccagaaatattgccccacaacgaatgatgtatttttatcgctcctcgtgtactttgatagaatatccaagagatgcaatagtgtcactacgacccctaaaactaatactgcaaaacatgaatcttcctcaaatgaaagctctctagataaagctaacaggggcgctgacaaaatgtccgcatgtaacagtaacgaaaataatgaaaatgacgattcagatgatgaaaatacaggagttcaaagggattcaaggcctcatcctcaaatgttcgtaatggattcacataatattcacagattaatcatagcaggtattactgtcagtacgaagtttctgagcgatttcttctatagcaattcaagatactcaagggtaggagggatatctttacaagaactcaaccatttggaactgcagtttctagttttgtgtgattttgaacttttgatatcagtcaatgaattgcagagatacgcggacttactatacaggttttggaacaacgcaaaagctcaatcgcaagcactagttacgggcatgtagaaatgcgtaatatgcaagtagatatatttacatacacagtttctctcaaaggtagtaattatcttatgtgttaacgtacggttgctaagaaataagcatggtaactttcttaggtaattctttggtattaagatatattctgaattacggtttggactactttattgttcagagataagaaacatgttgagcagcactttatggtgttgctatattcccgttcaaatacaacagcaacaaaaaatgcttttccctcatcaaattggacagaaaaaaaaaccatattattttattcaagcttatcacatgatagactgtatatggagcagtcaaaattgactgctaactgagttttcattttggaaatcttatcattttgcgttcaccgattctaacttattttcatcacgaatacgagaagggcaaaggtgccggcgtcattatgtgacggaaagaaaaattcgataaggcctttttttttcactcatcgtattgccaagcaattttagtcagaagtaacacgtatatatataagggcgtagacgtccctcttaacagatactctatagaccgtgctaacgtaaacacagcattaaaagtgcttgttacttcactattattagcattgaggcgcgtgtgctcggaaaacctaccatattataaaagggctaacaaatatgcctcaaacgcacgaaatgtccctgaacggcactcaatacttaaaatatgaacttaaagaccttgagtctcgagctcacgatgcaaagactccttcaacaaatgaattctatgatgatgtagaatcgcacggaacagaagaattagttgaagctaaactgtcgtttttgaacagaattgctgctagtttaagtgccgagacaaagggtattgaaccgattacagaagatgaaaaaactgatgattctatactgaacgctgcatctatgtggttttcagcaaatatggttctgcctgcttatgccattggcgccctagggcctatggtgtttgatctaaatttcggccaaagcgttttcgttattattttctttaacctcttaggcttggtatcagttgctttcttttctgttttcggtgcagagctgggcctaagacagatgattttgtctagatatttagttggcaatatcgcagccaggatcttctctttcatcaattttattgcctgtatcggttggggtatcgttaataccgtagcaagctcgcaagtcctgaatatggttaaccccggtcatcaatgtcctctttgggctggttgtatagttattatcggtgctactgtaattgtaacttttttcggctatggagtcattcatgcttacgagaaatgggcgtgggtaccaaattttgccgtttttttggtaataattgctcgtttggcaaggtctaaaaaatttgtccttggggagtggacatctggtcctactacagcaggtaacgtgctttcatttggatcaacagtttatgggtttgctgcaggctggacaacatacgcggctgactataccgtttatatgccaaggaaaacgaacaagtataaaatttttttctcgcttgtagttgggttagcaacaccattatattttactatgatacttggtgcagctgtagcaatggcagctatcggcgatccagcctggaagacgtattatgacgaaaattccataggtggtttaacttttgccgttcttgtccctaattctgttcacggattcggtcagttctgttgcgtgttattgtctctgtccactatcgctaataatgttcccaacatgtatactattgctttatcggtgcaagccacgtgggaacctcttgcgaaagtcccaagagttatttggactttattaggcaatgcggccgcactgggtattgccattcctgcctgctactatttttctaccttcatgaattacttcatggattccataggttattatttggctatttatattgccattgcatgttcagagcattttatttataggcgttccttcagtgcttacgatgttgatgattgggatagttgggaacgtctacctatcggcattgcaggtacagctgccttaattgttggtgcctttggcgtagcgttgggtatgtgccaaacttattgggttggcgagatcagccgtttgatcggagactacggtggtgatattggattcgagttaggactaagttgggcatttatagtttacaacattgctagaccctttgagctcaagtactttggtcgttaacgaaagttcatttgaatgtttcgctattttagtctttgtaatgtaacataaatggatctagtatgcaaatcattaaaaaatagcatgtatgttaattaaattatcacggctcattcatttgagttgataacgcaattctgataagcatatcacgtgactgtggttctaagagttactccgatcgccagtaaatactttatgagacgttgcattatttctgtttagttgataaattttgatttctagtctgttgaaagcctaatgcatgcagatgacataaatgtagtctgtttttgcactggtgatttgtaaaccagacaaatatataacatgataaccaaattgtttgttataagatacgcttgtcagattgaaatggagggtgtttcagaaggtgactaaaatatcgaagaaaagtatgccagaaaagtcagccatgtcaatggtcgatataaaagatgcgggtagtgaactaagggacctcgaatctggagctctggacacaaaatcttccgccgctgatgtatactatgagggtgtagaattgcatagaaccaacgaattcattgataataagccgtcctttttcaataggattgcagccgctttaaatgctgagacgaaaggtattgaaccagttacagacgatgaaaaaaatgatgactcgatactcaatgccgccactatatggttttcagctaatatggtgattgtagcctattccgtaggtgccttgggtcctctagtatttggcctaaatttcggccaaagtgttttagttatcatttttttcaatattttgggtttgatccctgttgcattattctcactttttggggtagaattgggtctaagacagatgattctatcgagatatttggctggtaacatcacagcaagatttttctctcttgttaatgtcattgcttgtgtcggttggtgtgttttaaatatttctgtttctgctcaacttttgaatatggtgaatgaaggctctgggcacaactgtcctatttgggcaggttgtttgattattgctggtggtaccgtgcttgtgactttttttggttacaatgtcgttcatgcatacgaaaaatggtcgtgggtacccaattttgctgcctttttggtcattattgcccaactatcgagatcaggaaaatttaaaggtggtgaatgggtagggggtgcaactactgcaggtggtgttctttcttttggttcatctgtttttgggtcagctgcgggttgggcgacttatgcagcagattacactgtttatatgccaaagaccacaagtaaatacaaaatttttttttccgtagtagccggtctagcgttccctctatttttcaccatgattcttggtgctgcttgcggtatggcggcccttaatgacccaacctggaagtcatattatgataaaaacgccatgggtggtgtcatatatgctatcctggtccctaactctctaaacggattcggtcaattctgctgtgttttgttggctctttcaactgttgctaataatgtccctggaatgtacactgtcgctttatccgctcaggctttgtgggcacctttggctaaaataccaagagtagtctggacaatggcaggtaatgctgccactttaggtatttccatccctgctacctattactttgacggctttatggagaattttatggattccattggttattatttggctatttatattgccattgcatgttcagagcattttatttataggcgttccttcagtgcttacaatattgatgattgggatagttgggaacgtctacctatcggcattgcaggtactgctgccttaattgctggtgcctttggagtagcgttgggtatgtgccaaacttattgggttggtgagatcagtcgtttgatcggagagtacggcggtgacattgggttcgagttaggtggaagttgggcgttcatcatctataacattgtaagacctttagaactcaaatatttcggtcgatgactaaatgttaattgattaatatttttgctaatcattgaaatgattggttttaatggataaatctcgacattcgaatagatagcatataattcaaaaacgattataatgggatatatataagtttaataatattaactcccttcccatttcttgaagagaagagatgtgttaactcctccaaatccgaagctgttgcataatgcgtacttcggattagctcccacaataggtttgtctcttatgaaatgtagcttatcggcctcgttattttctagagtcagaacattgttcaggtttaaggtatgcggcatcttatcatccttcaaggaacaaattgtaaatatactttctacggcgccagctgcacctaaaagatggccaattgcacctttgttactggatatgtacagtggcttgcttttggatcttcctggtaagagtgctgaggctactgccagacactctgctttatcgcctagtaaagttgatgtagcatgtgcattgacgtagtcaacatcagttggttctaatctagccatttttagagccatctctattgctcttttggcaccatttccatcagcaggaggggaggtaatatggcaggcatcactgcttaaaccatagcccacgagttcagaaattatgtttgcatttctcttttgagcatgttctagcgattccatgacaatcattccgcatccttcaccaagtacgaatccagaacgttgtgtatcaaagggtctagagatcccgtttgtagtaatcgactttgctctgatgaaacctgctaaacttaacggatgcaaactcgtttcacttgcaccggcgacacagatgtcttgcatgcctaaccgaataaaattgaatgcatcgccaatggagttattacctgttgcgcatgctgtggaaacactatgggataatcctctaaggttaaacttgatggaaacattaccagctgccatatttgtaaggattttagggacgaaatatggatttattcttttattgtcgttatggaattgtagagaagtttggtatatgtcttgaatggatcctataccagaacctatcaggcaaccaaagtgatccagattgcacagagatgtattgatggttatatcatttgggttcaagagaccagcattgtgaagcgcttcataagttgtacgtagtgctagcttgataaagcttgaggttcttctctcatcctggctagtgaacagcagtttattgatggctgaattttcgttttgaaaattctctggaatcttccccactgttatcgttgatgggatacttttttctctgggtttgtagtcctcattatagttgggcaaagatgtgattggtgtgagtccatttttggaagagagcagattcccccatgactcacttaatgatcttcccaacggcgttacacagcccaatcctgtgataaccactcttcttgacatttctttactagaaattaaattttaatccgttgtggctcctgtcactttcaagttgctaataacctgataacgtttaaggattttacttccttttttatcttttatttttctgagatgagacagagtcagaaataatagcacactatatgttttaaaaaaaaaaatctatctacgtatttatttaatcaataagatgtgattttataaatgtgtcgttttttagcatcattacttgttttgtggcgaatatagaataggactgtatctgagaattattacttaaatatgttcgattttagaggattaccatttcaacagatcgtccttagcatataagtagtcgtcaaaaatgaattcaacttcgtctgtttcggcattgtagccgccaactctgatggattcgtggtttttaacaatgatgtcgcagcctttttcctttaggaagtccaagtcgaaagtagtggcaataccaatgatcttacaaccggcggcttttccggcggcaatacctgctggagcgtcttcaaatactactaccttagatttggaagggtcttgctcattgatcggatatcctaagccattcctgcctttcaaatatggttctggatgaggcttaccctgtttgacatcattagcggtaatgaagtactttggtctcctgattcccagatgctcgaaccatttttgtgccatatcacgggtaccggaagttgccacagcccatttctcttttggtagagcgttcaaagcgttgcacagcttaactgcacctgggacttcaatggatttttcaccgtacttgaccggaatttcagcttctaatttgttaacatactcttcattggcaaagtctggagcgaacttagcaatggcatcaaacgttctccaaccatgcgagacttggataacgtgttcagcatcgaaataaggtttgtccttaccgaaatccctccagaatgcagcaatggctggttgagagatgataatggtaccgtcgacgtcgaacaaagcggcgttaactttcaaagatagaggtttagtagtcaatcccattccgaatattgtttttattgttttatgtttttccactgatctggtacacactagctggttggcgctattaatatgaaaagagttagaccaaattgagcagaaaagaaacctttggcaaacctaactatgttgttttagcttgtatatttaagcgcatatatatatatttctgaaaatgacaacatcaaaagaaacgaacttatttagaataaaaagaaacgacttggcttcttattattcctactttacgtcacgtgggaggcccgtttaggggggtagctatgtagtttttccgagcgtactttctttcagcatccgaaaagtcctcacttgacggcttacacggaaacgccgcggattgtggggcacagatgatgacgcggacggaacactgcagaaatctttttaccttgtcgttaaagacgatattaaagagaagagtttggctggggacaaagtgcagcttttcgttcagggcgaggtgccaaaatacttgggaaggccaaaccccaaaggacagggccaaatacgtacgctacggtaatatctaatgggagggtataacattgaccattttcgaaggaggcataggaatttagacgccgatggatgttatcaatattgaagtttttcaccgtttccctctttctctgttcctttaaagaacgcaaagtctcctcttgagagaaagcagacgattggaattggtatctttcacgtagcattgcttaacctacggccatgttaatgatatgaagtcatatgaaaatggccgaggccagcggttcattcgaggatatatattttattacccggcgtctctagccgaagtaagaaaacacaatgcaaccagcgttggtggaagggcgtgataatgctgaatgggagaagaaagttgaatggtgactcttcaaatgtgtcctttcaggatgcgctactttcagaagttacaaagatatttgtatattgaatagaatttttttcaccactagaattgtccttggagccagcacaagcacttacaatggcagattattcttcccttactgttgttcaattgaaagatttactgaccaagagaaatctgtctgtaggcggattgaagaatgaactagttcaaagactgataaaggacgatgaagaatcaaagggtgaaagtgaagtttctccacaggaacaaaaccaggaacaagggtcagaacctgcggcaatagaagaaccagcctcccagaacattactgaaaaaaaggaagtttcaagcgagcctaaagaaacaaacgaacccaaggaggaaaataaggacgtccaaaagccctctgatggaccttctgctactgcttcagagaacgaacaagctgctgcttccactgctgctcccgctttgtcaccagaagaaattaaggccaaagcattggatcttttaaataagaaactgcaccgcgctaacaaattcggtcaagatcaagcggatattgactctttacaaagacagataaatcgtgtggagaagtttggtgttgacttgaatagcaagttggccgaagaactgggccttgtcagtaggaaaaatgaacctgaaagtggcaataacggtaaatttaaaaatagaaacaaaaatgcaaacaaccgctccagagtaagtaaaaacaggagaggcaaccgctctggttacagaagataaaggctcaagctgttttggtggagtttttcattctagtttcggttctttcccactttttaaacgaccgcagttgtttgtatatgaaggtgcaaaatttgttgcatacgtaaacatgtgtagattattctaaataaatctgtgttattaaatccgaagagtcggcggttcactgtattacacatacagtggctgtcaacgttgtaaagtgctagtagagaatgagcggcgagatttacagactgaacattcttgtacaagttacaatgataatagaggaaaaataagctatgataaatagttcatagtaatgcaggtggggatgatgcaagcgggcctatttattttgaaatagtactgaatggtttggaaacggtggaattttcaatctgcaacgatatcgcgctcaacatctttaacctgtcatcatcgtacgtatttgggacttcaattgaaggcaatgtaatgatagtgctatctgccgatgtgtttgacctcgtcactcgaggctcttctttgccgggagtgcttgcatctttcgttgaagaatgtgcactcaagacctcagatgtggagtatggcctcattggattggactgtttattactacaaaccaagggatattgatggagtgtcatgtgatagataatttcgttgattggtaccaaagatgcatcaaacccataatctttgacaagagatcccagtatgagattcagcactctcacctgaattttttcttgtgataggtcagcgaatagttgacgtgtagcgggcataaatagcctttgcgatagaatagtcaaaaattcgattgatgacagccgttcagtaagatattgcttagtagaagacggtaaatgtgaaaagctgttttctaccacaagggaaatggaagccattagtgaatttttgcccagcgtttctagactagcaaaagaatccaaatttctttcatccttagacatctccaagcacgtccttgagtcatgtatctttgacaggatgagttttctcaagttattggatattacaactttgctttggcacccttttttttccgttaaatttggtctaatgaacttatctctttgaatttgttcaggtagtggaatagcattatttacaatttcaacaattattgatttggcaataaagtcgtattcttggtcactttctagaggctgatcttctatatcaaacttttgtaatttttcatcgccgccgtgcgcatacggtgccgatggatcacgaagaagagatgcgttctttttaagtaaagagcgaacttgagttggtacaggtggaagagtgcggccattcggataaggtaacaatttttgtgatgttatagtattaagagaaggaagagcgtgctcagcaggttcttccttcacgctggcttcttcgtcagagcttgatgcattggaagctgaacaagaccccatattacttgagctggggggagacaaaggaattttttgaactttaccacgggctattttcttcttagagtctaataattttttcttggaacgtttcctgtttcttctcaccgattgaacagcagcggtaaccaacttttcaaattctgccgaaaacgtatcagggtactcaaattcactccttaatatggtggctatttgtcttatattatcatcttgttcacttgctttgtgctggctcaagccaaatgagtcaatgagttctagtcttctgctagaaaacttcttccatttcttttcatcattaaagtttaactgagctctgattttatgtgtagtaccatagcccgtatattttcctgttttatggctaccttccaattgaattttggagttctcagtatcgtcaatcatcttgcaatttttactctgactgttgctgttttttttgctaagatattttccggttaagatgtttgaatatgctaaaggtaatatacagctagagaaatatgaaaagcaagaatataaaaatagaacaggagcacttagttcggttttttgccatcatgtttaatatatatatatatatatatatatgtgcgtgcgtgtgtgtgtgtgtacatgtatgcggcagctaaaagatgacgagtaccttctaacggccatgttattttctacagaaagcatctcactttgagcgcccagaaaaaagaaaagggagaacaaagtgattaattttgcctctcgattacattatgaggtggcactatttgtcacatttcatgtttttcatcccgcacttggctttcatgagaaaagcatgtaggacgcttgagtttggcatgcgaaagaagaggcgtgtcagaaaaaaaaaacgccttttgctcttgagaagagcggcaaaaattgccgaacaggtggaatttctcgaccaaaggtggggtaaatatcggttacccgtttgcgagttcctttacagtctcaatgatttccaagatgactaagggaatattttccatggtgccttttgcctcgcgtacactcacggcactaatgggcgatacgatactatgattgtgttcgggattagttcgattcaatcattcgcgcacgaggcatggacagaaatggcactgattttagtcaccgagtcaacaaaaatgaggcgactcgatcaaagatgtttactgactcgtttttgcaactagagaaaggcattcttgcacggagagaaaatgttgactttagttggagtaccattagagagatgccattagagaacattatactgcagtaacgatgagtttaagtttttaagtacgcatgtttatatatgaaaaaaatatacattgagattacgaatatatatacttgtcaggaaatgccggcagttctaatggttaatccttgtcctatttctttacgccattttctttgaattgatcttctgtgacaccggttcccatagcagctgttgcgctaacaccaccttgagctaacttcaataacccatcgatgtactccgcaccagaccatttttgatgtttcaacacatcaacaccatcgtccatttccctctgctgaacattctgggcataagctttcatcccatccttggcaaagtcacgagagaagttatggacagctaaagcgttagtgtgtaaaccggccaatgtgataaattgccagatgtaacctagatcacccagcctttggatgaaggtgtgttgttcatcaacggacatggcttttggccagttaaaggatggagacaagttgtaagctagccattggtcagggaatttctctttaacaccttctgcaaactccttggcctgttggaagtctgggtagttagattccatccataccaaatcagcatatggagcaaatgcacgggccctcatgacagaacattgcgtcccacctctgtaacggtacaacccttcccttacgcgtggtagctcccagtcgaagaaaatttcgtggccaagaatttctttagcgagcttcttggcttctctgtgggatgtttcagtcaatggacccactttagaggtgaatttcttaatcaattcttgcttatttgacagggctgatctttcaatttcatcaatgacggcttcatggaataacttgagtccagcgtctctacaccatttttgttcaatgtcagctagttcttgtcctgatgcaccactcatgatggtatcatttaaaacttcggcaaatggctcgatatttggattggtggcaccgacaatgaaataatgatctctggtatcgatggttgagctaatcaaagtggctgcttctgaatcagtcctagcaacgacaattaagtcagaatgcatgatatcagcacacattctaatagtcaccaatctgttaacatgttcctgaacgggtataacacatcttcctgccatatgcccacatttcttatttgtagatgtctggtcttccatgtggatcccagcagcaccacgctcaatgaacatcttggtcaatttgaagactgcggttaaaccgccgtggcctgcgtctgcatcagcgacaattggtgttaggtagtcaattggggcacccatctcatcgagttcttcctgagatttagcctttgaccgtgcctctagttgttttctgtcgtgaaacaattgggccttgaacaaatgttccactttgtttggaacggtgtccattggataatcagctaagtctggaccaggttcatttgaggtggaagcagttgatgaacactgccaaccagaaatatagattgtgtctaagtattttgccatttgagaaatctgaacaggatctagggcaccgaaagttttagagactgtaccctcattgtgatgcttctctaataccttgaataattttctggccatgaccgaagatgggtattcgattggtgggaatgtcccacgtctaacagcaatatctctggctgaataatttctcttagtcttactccaacgtgagtcagaccaccatttctcaatttcggcagcatctgcatctagttttgcttgtaaagctgcaaaatcgtttttcgtatttccaacggggataggcatttttcgttgactttttgttatgttatgctaagagttttctctcaattgttatatatttgggtgtgaaaagaaaaaaaggataagatgaaattagcaagccaagacaaataataagaattttgccagtgaagcagctcctttatataataaagaaacgttttgtgaattccgatgtgcctggttaagggcggactttggactgacttatgcttttctcttttgcaccaatattgagtcacatactgggatgctagtccggactatggatattttcttctgtaaagggtagtgaaagatgacgttgagtgttaattttgtggtgattggcttcagttttgattgtttcggatgaaatgaaaaagtgacgaagtcagataagtgatctctcggatgaatggaaacctggggcaaaagggaacagtttttctcatcggatgacgagtagcaaaacccgaccgcctaaagcatccgggttacgagatatttactttcaataaatagattcaattattattattttctcgagacatattactgacacaagaaatttcctatgggagcttgatttagtttttccttctaacattgtcattttaactgtgttgccttcccttgctcgcaactatgctacgctatattgtactcttgaattttatttatgttttgttcccagcgggcatcctgcaataaaatgaactcaagaagaagtaaataataacaagctataatgggtggccatttgtaatcaaatttggagtaaaacacgtatgattatgtttgaactctctttcttttatacgaaacctcaagcgacgtaggtgatggatatattcacaagataacaaaggccgtgttacaacattagatatgtaaacaacgtactagaagttctcctcgaagatctcgaaatctacaaaagggaatcgatattttatacataatcctattattattttttcttccattttatatgctcactcattatcctttacatttccaaaatcatgcatttcagcctccattaaattttgatggctgtctcttaattttgttatctttctttatgtcatcctcttacagagtatatggtaatatactagtaatatgattaatagtcgataagtgagtgtgaatttttattccgaaaaatatatgacgatgatcacactatattttctagaaataacttaaaccatagtgaataagaatctgtagtgctccttgagaactaatgaaattgcgctaaaaacaaacctagttaacataatgtttaggccaggaagaatctaaatacaaacctcatcagtcccagcgtacgcgtcatttacatttgcgtattgaaaatgaaaaaaaaataattcatttgaagcactactattacaaaacttattccagcccaacattcagtttggaaggatcaaacggtcttcgaccatatgaagatattccagtaaatatggtcttcaagcagttcaactacttttcatgaatgtagcattttcaaggcacctctaacaataaaaaaaacgacaccagcaggatttgaaccagcgcgggcagagcccaacagatttcaagtctgtcgccttaaccactcggccatagtgcctatcattatgaatttcccaaaaaagaaccactatcagagacatataaaaataagaacacatccaccgatatctgttacaatgaaaccctaaaatatcatccatttggggtagtattcatgctaccagtatatcctgtatgcgtaatattatagccttttccaacagtgcacccaaatataatcacaaatcacccaattctcaaattcacttgttaaaatggaaataccaaagcctcatcataccgttctattgtccatctccaacacaaaagtaccataataatttttcgattcgacacgaatacagatagatgggcacatggcaaacttagctcagtatgggcttgtaggttgtaaacgagtcagaaatttcaacaataaaaaatacatcagatagtgtttcgatgttcttaattacacgtgaattatcaaaaaccatcaacataccagccaacatcagtgtagatggaataaaactttcttaccatgtacagtaaatggaccatgacaccgtgcacaagcttatgcataatgagctaagcgggaagacattttcaaactagttgatagttccgactgccctttcaattgctaatgtagcaatatgttaggaatgcaatattccaaaatgctgtctgtgtcagtgagaataacaaaaacattgaataaacttttctatggtaataaccacgccaggtaagggcgttgccatcgttttcatttttttttttttcaaatggtggggtcaccgttgtgaaaagaaacctttgattctcaaccatatcggtactcggactaatcacttaaatctttccaagggattatcgagaatgtcatagtgcaaaataatcttagctttcaataattttttcatttggagtcacactcccgttaaaacctagtcaacggctttcacttaaagctatcaacaaggggcaattgattttgcactttcgtctaaatgaaagttgcagccagcaatttacccgaagtttaaataaatcaatgcaaaccatgttcaacttaaacagcaatcgctttctattaccttggaattatatcagaacgtctatctgcgaagcattaataaagtactggaagttgtgtctgaaatgtctgttggtaaattggtttgatcctgattatacacctcaaaggaccacgttaagtggccatatgacgagtgttattgcgtgcttgcaagttgaagataattatgtcattacaggaggatgtgataaaatgatcagagtttataacttagtaaataaaagatttcttttacaactatcaggtcatgatggtgaggtttgggcattgaagtatgcccatggcggtattttagtcagcgtttctacagacagaacggtgcgagtttgggatattaagaaaggttgttgtacccatgtgtttaaaggtcataactctacggtgaggtgcctagatatagtagaatataaaaatatcaagtacattgttactggttcgagagataacactttgcacgtttggaaattgcccaaggagttctccgttcctgatcatggggaagaacatgattatccattagtctttcatacccctgaggagaacccatattttgttggtgttttaagaggacatacggcgactgtaagaactgtctcaggccacggtaatattgtcatcagtggctcctatgataatacattgatagtgtgggatgttgcgcaaatgaaatgtctatatatcttgagtggacatacggatcgtatttattcgacaatctacgatcatgaaagaaaaaggtgcatctctgccagtatggataccactattagaatttgggatttggaaaatataaggaataatggagaatgttcctacgcaacaaattcagcatcgccatgcgtcaaaatacttggtgctatgtacactttgcggggtcacagagccctagtcggtttattgggattatccgataaatttttagtcagtgcttctgcagacggttcaataagatgttgggacgctaacacttactttctgaagcactttttcgatcacacgcagttgaatacaatcaccgcattgcacgtttctgatgaggtattagtgagtggatctgaaggtttgctcaatatttatgatttaaatagtgggctgttagtccgttcagatacattgagtggtgctgataatgtttggaacgttagttttaaggacaacacacttgtggcagcggtagaacgagacaagcgaaatcttttagaaattttggactttagttgaagattaatgtgagaatgatgcagaacttaccttgtcacgtttggaactcagttgtactttttcggtgtaaacaaatataaaactttagaatttacattaataagttatgtgctatttattagtttaatatatcaacattaattacatgcgagctatgtattattagctcaatcagcaggactaaaatcgaggaaaaagtaattttgtttatgcccagttcagttatcgtccatttgtagcaaatgtggtacaagttgacccatattttcatgcattgggccatgcagtaattatcacactcactttgtcataatgtatacaatggccgcttatttgcgactcgtctcatatttttcctgaaactgtagctgtgtgtaatattattcattaacttcgataattcggctacagaagacaagagctacatccttactggtgcgaataaatgacataatctgtcaagagtacagaagtaaaagcaacgattgccgaacacatcttcctgaagtatcatatgccaatacaaggtttcaataggagttatgaaagcggcattatcacccttaatctgaaatatgtaatgatgacggtgcagtatgttgactacattgtaaagttgcactttcactcaactcatgaaattgatgacattaatcctacgtgacttacacatatgccatgaacgaagaaggtggcaccaaaaatccagcgtttccgatatacacgcagtcaaatgttcagactaaactttggtattctgacaacgtgttgtcatacctgttacgagccagaaacgtatttctttttgggtgatacaatctccagatgactgcttttttttttttaccccagattcaggggccgaaggaacggaaatgcggtgtggcgagattgcggatgtgctaaaaaataatatcctcgaggcaaccagcataatgtggacggctctcggcaattgacttccataacaaatgcatcctgtaatcaggggtattataagttactgtatggttaattaaatatagaatgaaaggggcagcgttcttaaggggtattgctgggtggaaaaatacaagtgtctttacttgattgtgtgcacatatataaggcaaaagatttctagcgtatatttgaatcttttgttcttccacgttcaaatttctttggtcaaaacatttcataaaggggcaagttctgcattgtattctaataattgcccatagaacatataaattaggtatcgactgttttcgtctccactttaaatgacaaggaaagataagaaggaagtaaaagttcaaacggttaccacggaggatggtgaaaccgtgaaagtttttgaagacctgcagggttttgaaactttcattgccaatgaaactgaagatgatgatttcgatcatttgcactgtaaattaaattactacccaccatttgtgctacacgagtcgcacgaggaccctgaaaaaattagtgatgctgcaaattctcattctaagaagttcgtgcgtcacctgcaccagcatattgaaaagcatcttttgaaagatattaagcaagccgttaggaaacctgagcttaaatttcacgaaaaatcgaaggaagagacatttgataaaatcacctggcattacggtgaggaaactgaataccatggtagacctttcaagatagacgttcaagtagtttgcacacatgaagatgctatggtatttgtcgattacaaaacacatcctgtaggcgcaaattaaaggttgtgtcatagagaatgtgttagtactgaatcctaacctcccaaattcataagtagttttatgtacctttaatgatttacgattagcaactttttgaattttttttattgaaatgttgagcccgaagacgtgaaacgctataatgtagtatcactgttacgccgcgaaacctgataatgtattgttaaactactacctggtcgatgattatatcggcgcttctaaaatgaatgctattacccgaacttccacttgattgccgtctcttcccgggtaacattgtaagtgtgaatatgatttttttttttgctttctcttttcaaaatttccgaaaagcatatcaagacgtgtactacatacagtaaaagccctcctagggttttcagtagtggttcgaatagtatagattactgcttttgttactctgcaacaatcccaaaacttaataaaaagtacaaaagaccaaataaaagtatcgtatataatccagtcataatgatgaatccacacgttcaagaaaatttgcaagcaatccacaacgccttaagcaattttgatacgtcatttttatcggaggatgaagaagattattgccctctttgtattgaaccaatggatattactgataaaaatttttttccttgtccctgtggttatcaaatttgtcaattttgctacaataatatcagacaaaatccagaattaaatggccgttgcccagcatgtcgtcgtaaatatgatgacgagaacgtcagatacgtcacattatctccggaggagttaaaaatggagagagccaagctcgctaggaaggagaaagaaagaaagcatagagaaaaagaacgtaaagagaatgaatatacgaataggaaacatttatctggtaccagagttatccaaaagaatttagtgtacgttgttggcatcaatcctcctgttccatacgaggaagttgcgcccactctgaaatctgaaaaatattttggccaatatggtaagataaataagattgtggttaatagaaaaacaccccattctaacaacacaaccagcgagcattatcaccatcattcaccaggatatggcgtttacataaccttcggatccaaggacgatgctgcaagatgtatagctcaggtagacgggacgtatatggatggccgcctgatcaaagctgcctacggtactactaaatactgttcttcttatttaagaggattgccatgcccaaatcccaactgtatgtttttgcatgaacctggtgaagaagctgattcttttaataaaagagaactccacaataaacaacaagcgcaacagcaaagtggcggaactgcattcactagatctggaatacacaacaatatatctaccagtaccgctggttcaaataccaatttactaagtgaacatttcacaggcacaccttcaccggcggcgatgagggctcagttacatcatgacagccatacaaacgctggaacaccggtattaacacctgctccggtccctgcagggtcaaatccctggggagttactcaatcagcaacacctgtagcctctatcaatctctctaaaaacagcagctccataaacttgccaacattaaatgattctctgggccatcatactacccccacaacagagaataccatcacaagtacgacaactactaccaataccaatgctacaagtcactcccatggtagcaagaagaagcaatctcttgctgcagaggaatacaaagatccttatgacgcactagggaatgctgttgactttttggatgcaagactacattctctatcaaattatcagaagcgccctatatctatcaaatccaatattattgacgaagaaacttataaaaagtatccgtctttgttttcttgggacaagattgagacctcaaagaaaagtgacaatacattagccaacaaacttgtggagatcctggctataaagccaatagactacactgcttctgtcgttcaattcttgcagagtgtcaatgttggtgtaaatgacaatattacaatcacagataatacgaaaactcccacccaaccaataagactgcaaaccgtctcacagcaaatccaaccaccattaaacgtcagtacccctccaccgggtatctttggtccacaacataaggtgcctattcagcagcaacaaatgggtgatacaagctcaagaaattcctctgatttactaaatcaactaatcaacggaaggaaaattatcgccggtaattaatccgactctaaatatttttcttgtttgcattaaccataattttatctatttttatttctcatgaatatataatctctccgtttataacgaaatgcaagaaaaaaaaatctcacccatttttttaaacttttgacgtggaaaggtatctgggaaaggtatctggctaatgaataatgccatagcatataccagtatagtctatttactcgttacaacgtatgaaagcgtcagcgctgcaagaatgactaattcatagaaaataatcatcatgatatatatcataatgcacggaacctgcttcgctaattttttcacttaaatcacattttttcaacgaaatctcttgcgcagttggttggaattcttatccgaatgactcagtctacatcaaaaaactgtggccgaatggtggtaattgatgactcttctattttttttttcatataaagagcttgcgcgcgtgttgttgttcgctatccatttccattaggaacatttttggatattatttttcagacccgtaatatacttaacacatataccactaaaggcaaaagaaagagagatctgaagtgagaaataagtctgcatcattatgccatctgctagcttactcgtctcgacaaagagacttaacgcttccaaattccaaaaatttgtgtcttcattaaacaaatccaccatagcaggatttgcatctgtacccttgagagctccaccatccgttgcatttacgagaaagaaagtcggatactcaaagaggtatgtttcatctactaacggcttttcagctactagatccactgtgatccaactgttgaacaatatcagcacaaaaagagaggttgaacaatatttgaaatatttcacttccgtctcacaacaacaatttgctgtgatcaaggtgggtggtgccattatcagcgacaatctacacgaactcgcttcctgcttggcatttttgtatcatgttggtctatatccaatagttttacatggtaccggtcctcaggttaatggaaggctagaagcgcaaggaattgagccagactatattgatggtattagaatcacggatgagcacacaatggccgtagttagaaaatgttttttggaacaaaatcttaagctagttactgcattagaacagctaggggtccgtgcaagacccattacttctggtgtttttactgctgactatttggataaggacaaatacaagctagtgggcaatattaaaagtgtcacaaaagagccaattgaagcatctattaaggcaggtgccctaccaatcttgacctctttagccgaaactgcttctggtcaaatgttgaacgtcaacgccgacgtagctgctggtgaattagcccgtgtttttgagcctttgaagatcgtttacctgaatgagaaagggggtattatcaatggctccacgggagaaaaaatttcgatgatcaatttggatgaagagtatgacgatttaatgaagcaaagttgggtgaagtatggtaccaaattaaaaattagagaaattaaagagcttttggactatcttcctcgttcttcttcagttgcaatcattaacgttcaagatctacaaaaagaactgttcactgattctggtgcgggtactatgatcaggagaggttacaaattagtgaagagatcctccattggcgaatttccatccgctgatgctctaagaaaagctcttcaaagggacgctggcattagttccggtaaagagtctgttgcttcttatttaagatatttggaaaactctgattttgtctcttatgctgatgaacctcttgaagcagtggccattgtaaagaaagatacgaacgttcccacactagacaaatttgtctgttctgacgcagcctggttgaataacgtcacggataatgtattcaatgttttgcgccgtgattttcctgctttacaatgggtagtcagtgaaaatgatgctaacattgcatggcattttgataagtctcaaggttcatatctaaaaggcggaaaagttttgttctggtatggtatcgatgatataaatacaatatccgagctcgttgaaaattttgtgaagtcgtgtgacactgcttctaccctcaactcatcagcaagtagtggagtatttgctaacaaaaaattagctaggtcgtactcaactagatccactcctcgtcccgagggagttaacaccaaccctggtcgtgtcgcgcttattggtgctagaggttacacaggtaaaaatttggtatctttgatcaacggccacccatatttagaagtggcccatgtttcttctcgtgaattgaaaggtcaaaagttgcaagattatacaaaatccgaaattatatatgaaagtttgcaaatacaggatattaggaaactggaagaacaaaatgctgtggacttttgggttatggcattacccaacaaagtctgtgaacctttcgttgagacaatccaaagtgttcatggtaagtctaaaattattgatctgtccgctgatcacaggtttgtatcagaatcagactgggcttacggtttgccagaattgaatgatagagcaaaaattgcaaacgctgccaaaattgctaatcccggttgttatgctactggttcgcaattaactatttctccgttaacaaagtatatcaatggtcttccaactgtgtttggtgtttcaggatattcaggcgccgggacgaagccttctccaaaaaacgatcccaaattcttgaacaataacttaattccttacgctttaagtgatcatatacacgaacgcgaaatctcagctcgcattgggcacaatgttgcattcatgccccatgttgggcagtggtttcaaggtatctctttgaccgtctctattccaataaaaaaaggttccttgtctattgatgagatcaggaaattatacagaaatttttacgaagacgaaaagctagtacatgtcatcgatgatatcccactggttaaagatattaagggcacccatggtgtagttattggtggtttcaagctgaatgatgctgaagaccgtgtagttgtttgcgcaaccatcgataacttacttaaaggcgccgctactcaatgtctgcaaaatattaatcttgctatgggttatggagagtatgctggtatccctgaaaataaaattattggtgtctgatcaccgtgtatagtagatctgcagctcagtcacatgagacattaacgtatataaatatataaatatatatatatccattaaataacgaagtaggacatggtctaaaaatagtgcttctcatgtattgattttgagtagccataagaataattattgatttcaagatctttgatctccttacatccaaagttataataccactttatggtatcacgacatcaccacaacagagaaggattgccgcatttggatatcgtaaacaaaggcgttaccatagaaatgtactgattggcagaattactcttcaggagaatctttcatacaaaggaattccattggggaaaatctcgttaccaagtcaatgctgaactttctatggcctttgtttactatcgttaattattttacgaccacttctgggtagaaatatttcgtagccctggaacgagcttgtttacgcgttttatcccattatatggcacccaaatcaaatttaaaaagaaaaaacgcgtaaacagtgtcgggtaagttcatcccctgttactttaattgcttctttttttgaaattctaagtaaacgcgtcattttgatcctcaggacacagaaatccttgcagaatcttattgggtgttgaatagaggacgcgtaaaaacgatatggaaatttttttcatatagtgtagaaagaataggttggcgtaggtagtttcgtgtttgatagaaacctccaacaaagtctgcggctcacgttttagaataacaagtttagagtttatcttgttgcctttgttaagtcagtaccattgaataaaaattatataaaggagctgatatttcattgttggaaaattactctaccataattgaagcatatctcatccttttcatcctttcaacgcaagagagacaccaacgaacaacactttatttgttgatatattaacatcatgtacgtttataaaagagacggtcgtaaagaacctgtccaattcgataagattaccgctcgtatatcacgcttatgctatggtttagatccaaaacatatcgacgccgttaaggtcacccaacgtatcatttctggtgtctatgaaggtgtcacaacaatcgaactagacaacttggccgctgaaacatgcgcttatatgactactgttcatccagattacgccaccctagctgctagaattgccatttctaatttacataaacaaactacaaaacaattttctaaagttgtcgaagatctttatagatacgtcaatgctgctactggtaagcccgctcccatgatctctgatgatgtctacaatattgtcatggaaaacaaagataaattgaactccgcaattgtctatgacagagattttcagtacagttattttggttttaaaactttggaacgttcttatttactaagaatcaacggtcaagtggccgaacgtccacaacatttaattatgagagtcgcactaggcatccacggtagagatatcgaggctgctttagaaacgtataacttgatgtctctaaaatattttactcacgcctctccaacgttgttcaatgccggtactccaaaacctcaaatgtcctcttgtttcttggttgccatgaaggaggactctatcgaggggatttacgacaccttgaaggaatgtgctttgatttccaaaactgctggtggtattggtctacatatccataacattcgttcaactggttcttacattgctggtacaaacggtacttctaacggtttaattcctatgattcgtgttttcaataacaccgcccgttatgttgaccagggtggtaataaaagacctggtgcgtttgccctttacctggaaccatggcatgctgatatctttgattttattgatattaggaagaaccacggtaaagaggaaattcgtgcaagagatttgttccctgctctatggattcctgatcttttcatgaagcgtgtcgaagaaaatgggacctggacattattctctccaacatcagctcctggtttaagcgattgttacggtgacgagtttgaggctctatatacccgctacgagaaagaaggtcgtggtaagactatcaaagcccaaaaattatggtattccattttggaagctcaaactgaaactggtacacctttcgttgtttacaaggatgcttgtaacagaaaatctaatcaaaaaaacttaggtgtcatcaagtcatcaaacttatgctgtgaaattgttgaatactcagctccagatgaaacagctgtttgtaacttggcttccgttgccttaccagcattcattgaaacttctgaggatggtaagacttccacatacaacttcaaaaaattacatgaaattgctaaagttgttactcgtaatttaaacagagtcattgatcgtaattactaccctgttgaagaagcgagaaaatccaatatgagacatagaccaattgctttgggtgttcaaggtctcgctgacactttcatgctgttacgtttgccatttgattctgaggaagcccgtttgctaaatatccaaatctttgaaactatttatcatgcctccatggaagcttcttgtgaactagctcagaaggacggtccatacgaaactttccaaggatctcctgcttctcaaggtatactacagtttgatatgtgggaccaaaaaccctacggcatgtgggattgggacaccttaagaaaagatatcatgaagcatggtattagaaattccttgaccatggcaccaatgcctactgcatccacatcccaaatattgggttataatgaatgtttcgaaccagtcacttccaatatgtactcccgtcgtgtcttatccggtgaattccaggttgtgaacccttacttactgcgtgacttggttgatttaggtatttgggatgagggtatgaaacagtatctgattacacaaaatggctccattcaaggcttaccaaatgttccacaagaattgaaggacttatacaagactgtttgggaaatttcacaaaagactatcattaacatggcagccgatcgttctgtctatattgatcaatctcattctttgaatttattcttacgtgccccaactatgggtaaactaacaagtatgcatttttacggatggaagaagggattgaagaccggtatgtactatttgagaacccaagctgcatctgctgcaattcaattcactattgatcagaagattgcggatcaagctacagaaaacgttgctgatatttccaacttgaagcgtccatcatatatgccttccagtgcaagctacgctgccagcgatttcgtgcccgcagctgtgactgcaaacgcaactattccatctctagatagctcctcggaagcttcaagagaggcatctccagctccaacaggtagccactcattaactaaaggaatggcagaattaaacgttcaagagtctaaggtagaagttcctgaagtacctgccccaactaagaatgaagaaaaagctgccccgatcgttgatgatgaggaaaccgagttcgacatttacaactctaaagttatagcatgtgctattgataacccagaagcttgtgaaatgtgttcgggttaatgagggctaagtttttatttcttcaattctattctttatcaaaatttgggtgtttacttcgaggtgtaatttatattttcttttgttttctctgataaaaaaattggtttccattctaatgccaagctaaaaggtacctatatatgtttactaattatttttctactttgcatatatacataaaaaaagtcgaataatttaacatgaacattttaacctgtccttgtaagaaggccatgatacggattcccccatgccccgaaatggggtctaggcaacattgttttataaaggaacgcaactttatgtggcaacattaaagcaaatacatatctacttgtgaagccaaagaattgtaattaaatagcactcattactatttttgtcttctagtttatagttgaatataccatcttttttagattcccaggatgcgcctatatcgttcttcaatgagaaattagcgttttcttcgttgagtccttcaatgttcaacgtcgttaccgaggcaatatatttatacaaagaagagtgcttttcaagtttttctaggaccagttttataagaaggttggaagttgattcggtcgataaattgatttcattgtcatcttttaaactatcataactttcttgaattaacgtaactagttttctttcgggcagaggagagttatcactccttccatcctttatttcaatctgcatactcatttttttgttgactttcgtaatcacttactttcacttatcctaaataatttacagtgcgttttgtaaaactgcaagacggtatccgctaatagagagaagaatacgtattttctagtaaagaaatttacaaaaaaggaggtatattggcattgctattttcggatagaatggcaagagcgatcaagtatagcaaactgggaaatgtatagagacaagaaataatgagactctctcttcaagtatctttgagcacgtatcagataactaatggttatatcgcttgttacggtcggtgatacttcactttgaaatagatattagcacgtgcctcggagagaagaaaatgaatgctgcattatacaaaatagataacagtatttaagagtccatatttccataaccagcgacttgcatacacgtaacatacgatttattacattatcgaatacgattaaacactacgccagatttccacaatatgtcttcagcaccattattacaaagaacacctgggaaaaagatcgctttgcccacacgagttgagccaaaagtgttctttgccaatgagcgtacctttttgtcgtggttgaactttacagttatgctgggaggccttggtgtaggtttactgaattttggtgacaagataggtagggtcagtgcaggactatttacttttgttgccatgggtacaatgatatacgcgcttgtaacataccactggagagctgctgcgattagacgtagaggatcaggtccttatgatgacagattggggcccactttgttgtgctttttcttattggttgctgtcattatcaactttatattaagattgaagtacaatgacgctaacactaagttatgaaattgtaattccaatatcgtaagcgtgggttacgcacaaactgtattttcaagatgctcacaaataatttagtttcatataaacgcatatatagaaagtatccatctataggtaatcatgaacaataaaaatattcacgtttcaggagctattgtttgtactcattacgttttgaatgtcaagttgaaaatcagcccctttcactagatatcaagcgctataaaaaattttaatttcgatgaggcacctttcttttctcttgtggctatgtaagcctgagaagccgtctgcacatctatgataaataagtatacaaaaagggtcccatttttttttggccgctaccggactagcaagggcttaatggtacgctgagcgtagtacaaccaagcgcttgttagccgtagagttaagctcttgactactattacggtaaaagccgggaacgtgcgtaacaattttttttgcattaggttaaagaggctcgctcgcggagcctttagaataccgcttaaggcgccaaaagatggaagctattctctttcttttttttttcacaaactgagaggggttgtgtgtcgttaaaaatgttggaagacttctgactcatcactacgcagattgttagagtttttcgatgagaatggcttcaaagaacagaacaaaacacgattatataagccccatgtaaaaagaacgtcttaatttattttgaatttaggacttcttgacatttttagcatatataacaatacgataagtgtctcatcaaacgtggttaagacagaaaacttcttcacaacattaacaaaaagccaaagaagaagaaatgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaacccatctaacgaagaaaagataacaactgtatacaaggctatggaagacgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacgggtaaaaaccattttacctactcaattaaggaaccattaggcgtttgcggccaaataatcccttggaacttccctttattaatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatttagataaagccgttaagaacattgccttcggtattttttacaactccggtgaagtttgctgtgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaagaagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttgaagtaactcaggcccgagttgactgctcattgaaggtatgtatgataaacattatagaataatgaaaaatgcctcgtgacatacagataaaatctaataaggatatattaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnatatatagtaatcaaattcgtttcactgatcaaattgctcactagttctgtttttcaaaattcatctttataggtagatacaagtgccagagagatacataacagaaaactctatcgatgtgataatgtatgccaatatcgggactgtacacccacacatttacaagcccacacatcctacaactttcttttcatttcttgcgcttcttccactgtcataaaatatgattgtccgatgccgcagcctacgcctcggcgagtattcatcacctaagcgtcctgtaggcggggccacgcagtcactaacggaatactccagaaggctgcttcctttggaaggaagtttcactcgattgtccacccagcgctttaactttgtctcagcgaagaagaattgaataactatagtgaatttcaagagctagaggatggttaggtattagttcaaaacaaagatttcaagaaaccaacatagattaagcagaaatggtatgttaaaaagtgctcagatgaaagatgacgtcccatattccatgttaaagttgccatgagttagtataaaaggcaataaaggtaccataacgagaaaagaaagtaaaagaagaaatgttttgcaaatttaaggtggcgtaacagcaactattggctaatatattaatggcaatcattgtgaaaagaaatgtgaaatccgtatcgtaattggttaaatttataactcaaatttaaacactcgaatagctgacccgtaatattttatcccgctttaagagttcaacgctaaaaaatgatatctagctaaccattatgctacaggaaccttttttggactattatccctatcatgaaaactggaaggatctttcaaggacgccatttccaaagatttcccccacactggaacctattttactaacaatttttaaaatggttttttacctaaattgttttttctcagtctgacgctgttactatccgtactagaaaggttatctccaacccattgttggccagaaagcaattcgtcgtcgacgtcttgcacccaaacagagctaatgtctccaaggatgaattgcgtgaaaaattagctgaagtctacaaggctgaaaaggacgctgtctccgttttcggtttcagaacccaatttggtggtggtaagtctgttggtttcggtttggtctacaactctgttgccgaagctaagaagttcgaaccaacttacagattagtcagatacggtttggctgaaaaggttgaaaaggcttccagacaacaaagaaagcaaaagaagaacagagacaagaagatcttcggtactggtaagagattggctaagaaggttgctcgtcgtaacgccgattaagcaaactaacttcaaaacgttaaatcatttttacggattgtttagttttctatatataaatatgtgtatctttttccaataaaaaatataatcaataattttaagagatccgtggattcatttcgtaatagaaaatctcggaaaaatggtacagaatattgttggctaagtgcttcagattgcatcgtcagaaaagtaaaaatacccccgtaatccatcttctctacatttaatctcatagtgctcgtaatgtctcgaaatttgtctttcgtgatcattgcacagtcttttcatttgtcacagtcacgtgattacatttaagtacagtatatccaaaaaattagctggactgggagccttctcaataagttggcggtttatatactcaaacctattaataggaaagaactcacaaaagaagccttttggaagagaaaactttgatatagaggggatatggtactgtttggactaggtagactattttacgtcattttattattgattaatgccgttgcagtactgagcgaagaaaggttcttaagaagaagtatgtaaacaggagaggcaaccataaacaacttattttaaagcaacaattaatactaactttattgaatatgctaatacattatttcaccgatttttgcagttggccttggaagatcaaatgatgagacacctgtttttggtcaggatcaaaataccacgaagtccaaggttgttcaattgattggcgccgtacagacattactgaggagtatgttatgttgatggagaatgattaaagttacatttcatcagtttcccgttctttttcaccttttgtgagaaaattttactaacgtttcgtatattattcttgtagtaccattaattggaataaatatactggtgattgtttatgaattgctattgggatgaactaagcgtacaaagcaaatattacatattactatatacaagaaacaggctctaatagttttttttcccttcaccttttcggttttagctttattataaaagatatgaacaaaacctccaagggtagtggtagcatggtatgtgaaattagagagttcatgcataacttgaaatgaaaataatactctgttacgtagctaactactgccaaatatgtatcgaaaatatcaattattaaggggtttcgtattaataaaatagagatcaaatacattcatattagcctaactattgtggcaattctttcaacttatcatccacgaatgtctgcaagatctctaatttttcgatttgttcaattaatgcacttaatgatatattgtccttgttacttccatcaccatccgttctctctgttatgtcatcgagacgtaatctaaagtaaaatagcaagcagtcataaatgaaaataaattgattaatgttctggaccatggatattcgttgctttctaaaaatattaattgtccatgaaattggatcgaataactttgccgggtattttaatttaacaaactctttctgtaacatttcaaacatttcgaaattggatagaatggaatcaatggtacacaaagtaccagtccttccacaacctgcagaacaatgaaccaaaatggtaggaagttggtcgttttgatagtaatttctggcaaatagtgtatctattatgtgattcttgacattgattgcttgtaagattgaggtaggattgagtaaagtgcccaaatcaggccaatttttcacctgaatctgtaacaattcataaggtttctcttgatcatgatatgttagcagaatttttcttatgagaattgcatcatcatcatcatcatcgtcatcatcatcacaagcagcggcagtaacagcaatattactattgttattgttattattattgttgtcattatcattatcattatcagtactatagttactactatttccgtgaacaccagctgaatataaactactattttgtgttcccgtagtatttttcctcatgctagtagtgctaggcatctttaatatttttttttctaacaatttaacgtgaataccgttataattaccttcttgccaatatcgataacatttctcaatgccattttcgaaatcatttgtcaatgagagaaccaacggaacgccattattcaatatgcatgtataaaagtcatgtacagtggagggcattggagcttgcgtcgctatatagcgcactcttcttgttgtggttgaagttgtttgaaatgacgaattttgctctacagaaaaccttggcagagacaagtagtttgcgttgatataattgtcgaggatgccgccatcggaagtagaatgtgaatgcttgataccttttgatgattgcaaacctttttttagaatcactctcgaatgctcgtagggaaaaatatccttgtacctgttcttggctcctaattcaacgcctgatgatattataacgttatctgactccgaatcggaatctgattcaaggctgagcatcgatttatatttactgtattgagtgaagattggctgagaatgcgacctcttttgtactttgttcacgtcaggaaattttggaggcatgattgttgaagaagaagttgatgttaactgttcaggatatgatgatggcttttcaagtataaacgagttttccttcttcctgaaagagacagaatggttcaagcgccttttttccaaaaaatctaatttttgaaactgagaaaccaactcgatcttgggtattgacatcagatgctggaaccattctggtataacggagtcaatgacctccttttcgtaatttttgctcaggttttcgtatctgatctgaaaccctagtttgtctttattagtgtccttttctagagaattttggttctttgggaattggaagttttgtaaagattttttggcagaatcgttattataccatctttcatgttcttctttgatgttgactgcactcaaatacgtctctaaatccattatttcttcattttgcgaaaatttgaacatttggtttatgtttgtttgtggtgcaggcagctggaacttaaataaggcagatatgggggaagaagaagacatgggagaatctgataggacgttacgcggagagggagaactggaaaagtttgaatgatctgacctactatcgtcaggaactttcaacttaaggttcatttgcggagacgatagtggtgttgtcgccgtcatatgcggcgctgtgttgtgtagactgttcataaggtttgtcttggggcttttaggttcagccgaactaatgcaatctgagttaaatgtgttggtgtttatatggtctggaaatagaattttgaattgagggaaaccacacattagtatagacacggtttttttaacattagtatcaaactctattagcttggacgctattccataacaaggtaaagaaacagaactttccgtttgatttgcggtgctatcataaatgataatccgaaggttatcgatggccagtttagatttcaacacgctttgctcgctaggagttaagttgtccaagagtttggaaaaggtgaaatttttcctcctcagcagcgtggaaggcaaacatacatgaatggagtttgtgataatggatttggcatgttcggtaaacggcctaacatcaagtaagagcaccttttcatctggtaaggtttcaataatcttgcccagttctacagcagtaattagcgaacaaccctgcggcttattatatcgctgttccttgggcttgaagcttggcaggacaggagcggtcgccctcttcaataacaccggcgaagatgtcttatagctcaccaaagggctactggctttggggctgtggtatatgttgctgttcatgctgttatgataactgttcataggagcatgcttcgaatatacatgcgaactcgatccgaccaaagtgctagtctcggaaagcactgaagtgcggtcggtgggtagaatgcttgggcagtctacactgtccttcatgttctatatgataagtagatctgtgttgctgatggagaagggagatacaatacggattttctatgacctttgcagtgataagagcacctacgctattataacaccgatcttagaatgatatgcaagtttgtggtctgtgtatacagttctttgtttgtgcttgaagtgatgatgttacatgtcaaagaaagaaaaccgctaaggtcaatgaaaatatagtgttgcatccgccggtgcaaatggcgaggagaagattggactcttgcgcatcgaacactacctatctgcatccatccatgccaggtgcgcaaactgctgggtctggctaacaccacattctcgctgcgctgtgttctccgatgacgttttgccgcaaaatatttttttcatgaaggtcttttcttttcgttcagcgtcagcgggcccaaatctcaaagtcgccgccattctgtttaatgtttaaagtttccgctcactacaccaagatggcagcaggagatgccagaaaaagcgtggagtctggtcagatattagaagtatatacacatcggtgggtgtgtagcagtggcgacacataaaatggcgataatgggggtgattttacgtatagcatacatagacatctgtcgttggggtttgctaccagtgaacggatttaacgagcaagcagcgaaagtagccgaaaacctcttattcttaatagtcatttagcagccgttctgctgctgttttcctgtggggtgaggtgggctgtgattcggtaacctcgcttgcggtctaacaaaaacagaaaaaaacttggcacaaaaagctttcattggacgcaaccggaatcgaaccgatgacctcttccttgcaagggaagcgcgctaccaactgcgccatgtgcccagaatttctgtatgtattggatcttaacatggggtactcccgtataagcaattttaacccgtagatgattttagagtttcattcctacacgcatgaaaaaggtaagtgttggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatctcagtaagattgagtatgcctaaaatgaacggatcaaagttataaatacctgaagaaatgagtttagatctgttggatggtgaaacataaaaaacagaatgaggaataatcgtaatatttttatgtggaaatatcaagtccattgtgaggattccaatatcctcgaggagaacttctagtatattctgtatacataatattattgcctttatcaacaacggaatcccaacaatcatctcaaagttcaccaaaagtctcaagatccgacttagatcttatataatatgtagaattgcctgcatgagtgtacgattttacaataaaaaacgtcgaattagcttttcgcatacgtctcaaccaagaggagagcggtaaaaattatgggaaactcaattgttaaccttgcgcctgatcaaaacaatcattaatagccatattatttgtatcaacttctggacagtcaatactccagggataataatgagaccaagcatcattggcaactactctcagctcggcacgccaagaatcaccgtgactataggtaacacaaaacgctgtcttgccgtgattgtgcatactggatactgaagcacgaactgcacatgttaaattttcttcagaggctgtaatatcacagctactgtttgttgaccacgtcttgacaaacaaactccaaccctcttgcccatcaaaaaagatattcgtgaactcctggctgccgcaaaacttcttgtcaccgctcccgtgaacggcccatgcgacccattgcgctatgcagctgttcaaattagtcgtaagagttgtggaagagacggccctattgtacaacctagaccaagttcttacctccactccgtaaaacttggctctacagagggtagattcacctgttttctggttgcgtttgtattgcaggtctgctggtgtttccacagaaccgtcgacggctaaattaatggcattactgatacttattgccgtgacgtcattttgaagttgctcgacgagaatatgctgagtgaagttggctgcttgggtagttatattactgataatgttagggtattcagtagcatcacgcttgttgaaggactcaggcacagtaccatttgcagttaatcctatcgtctggtaaaattcaaccatggaaactggagcgattgccaaatcatcgtccatttgccagaatcctgatggcaagccctggctttcgccgcccgtcaggtagatctcagcatgtgtgcatgcgcataacaataagatcgcataaaaaaataagacggtatagtatcctgaggtcatttttctcctttggattgattgcttgcttgcttttgtatctttcttataatagttctttcagaagagcccaatatgcggttattatataagttaagttacggctatgtgaagattttgactaatgcaaaactgttagaaagcattgcctcttgtataagatgtggtcgcattacttcagttaatgacttgaaccagtttgtttttcaatccacggctgtatttttcactaataaaaccgattagcgggagtcagggaaatagaaagaatatttgcaaatggagcaccattttagaattaattttttttcagtgctcacaggttgatcataatgacaaaatattttgttctttagaattatttacatactgtttagagatgaatgattattcacacttattactatattggtctaaaatggttaacagtttgctcgagatgtcagcacaatctagtcttacataaaactttcttttttgtccccggaaatctggcgcaaaccctttttcataggattgacttaaaatagttgaagagcgctttctcttgcaaagaaggtgctaacccttcttactttggtttattttcgtgttggaacaagtagtacaaaaatatacaggcgagttgatataataacattatgtgcgttctcatcgtatacttaggtacatctcttatacgcttatatataattgcaacagtaacagaataatgaaactgttaaaagcaatatgtagacaatgacgcaattgagttacagatccaatatatacgtgaaaaatatgagttgttatactgaacatgttatatttacctgacataccactatattgtactgatgatacttaagacgtgccaattgcgcgtgttatatgaacctctccttcatagtataggaagatgtactttcattcttaattaacaccacctttgaataatttatcatcagtaactttcaattaacaaaaaaataggaaaaaaatttgaaaaaacctcaaaactatgtacatattgaaaggagtaaataatcaatttttacttaaaacttgtcatagctggtttcaagtatcagctcggccaagtcctccatgatgtgctcttcactggtacttgtattttcgctatcacccttccttcctgagttgccttcaatgtccgctaaatcttccagtaatatttgcttcagcctcaaaaggtgccttctggcaagaaacttctttctttccgtgccttttaaactggctatttcctcactgtccagtgacggaagcttgattctctctgttaaaaccttgactaaacgaattccctccaacgtaacaaaccgcttgtcttctatgctcgctttaaattccttcccgaactcaccattcaataaagatttcaagtattcatctagtatacttttcagttccactgtagacactttatcattcatgttcagatttttaacgataggaaacaggaacttccatgaattaaacctgtaaactttgccgttcaactttgatgagtatgtggcctctacgctatctataaacccccgaatcttgtgcaaagtagcttcagcatttgatgcatctttgtttataacggccttgagactttgtctttggaatgcgttgtacaccaaaattaacgtcctcctggttattgagatttgtgccgacgaggctacccgttcataaatgtccagacactcgtcgccgcaagtgatgggcctcgttgttatgacagtttccatgtatttgtggtatatgctctgatctaacatttggttgttctgtgcctctaatgtcttaaatatttccatagcaagatcatattccttgtttttcaaacagtaattcataaacaatcccacaacatgtttgttgagaggaaatggcttattgatgttccaatgacttagtggaactaatgtaggaaaatcgctttgtgtcaaatacttcttgaaaatggtcttatcaaattgaaaatattcacagagggcccatagtcccattccttgcttctcaatctttggtgacttctggctacatattacttcacagtactcaaataacaatttagaatcgacacaatagtctggtattttattcatcaaatcattgagtaccaccataaaacgtttctcatcggcaatcctggtacaagatcttatcattaaggtatatgtaatactatcctttttcaaacctgggcactttttattaagaagtttgaacactagtgtttcatcggtacaatttatcagtgccgccaaagcggtattatattctatttccgtgagctcatttttgtcacacaaactatctatagtcttcaaaacaagttctccgtatttttttgagaccaaattgtcttgttttgagagcccattaaagaggattgtgatggaatgttgatcaatagggactccccatttttttcgccaattgaagatatctacagcactttgttgggactgcacaacttcgaaataatatttcataatcaaattcatcccaacgacgcctttctttttagctagcctagccaaaaagacagctttttccagttgtcctcttttcaaaaatttttgaacatcactggcgattaatttggaatcacgtaactgttctccattgacgcctagtatggtataaaagagtctcttatctttggttaaggataggaacttcaagtcgctttggctagttggccccagttttgtatctgctagtgtctcattatttattttatgaaattttcgaagaatatgaaaagcttgatccttggggtatgctgtcttttgcagttttttcaattgtcttcttttcttagaatttatcctttccaattgtttggatgttttatttaatataaaaccgtgacgttctagctcatgtagtctttcttttacttgagttttctgtagatttgtcagtgaatgaaaagatcttctcagcagatgctctgtgagattaattgcagtgtttattcggggtagcattctagtaaatatacaagtgtctacacctattcttgaagactgcgatgactttgaggatgattgattgagatccttggttctcagctgtccttttgtaatttttagacccatctttattttgccgtaactaaaaataaaaactaaagagcagtgcccaagaagaagaggaaaaaaacaaaaagaaagctgaacaaaagtatctcaagatattttcagtaaattttttttttttgaattttccgtttaatattaaaagaccttaaatcgataagttatgtatctgtatatacagggtgtactcaatttagcaataacattacagtggtgccacttggtcctcctcgaattttgtagataagccattttgcatgacattttctaaatcgtcaatttctttcactgcttcaacagttaaattagtgtaagtatcttcaccaatggctatgtcatcttcaattcttattccgacgtttctaaagtaagatggaaatgattcctcgttaggaatatataaacccggttcaatagtaataacttgtccaacctttagtggttcgtacctggaaactttaggcacatcgtgaacatctagacctaaattgtgtccaatatagtgcggatacaatttttcaacattccaaccggagactttatctatgcccaagtttttcaattcctgtttcatgagtgtgatactcttttcatggatgtcgtggagggaatagttattgctagctttacataacttaatgcaatcacgctgaacatttaatacagcttcgtagaggtctctttgtgcatcagtgaatttcccactattgggccacgttctcgaaatatcagcacaataaccacccaaggagccagcggcgtctacaagaaccatttcgtcgtcaaacatcacatcatcgtttcttgtgtaatgaatacacaaagaattcgaaccagtagcgaccacggggatatatgcgtccttatcgcaaccaccggatataaacttgtaatgaagaaaggaatctaaagttctctcattcctaaatcttttagcaaaggcttgattgaacgatcttcctgatatttggccagctctcctcataattctcaactcttgaggggacttgatcttacggaactctgcaattcttttactgatgggtttgatggtcttattcgcaatggaattcaatgatcgattgctattcccactgccatctaacaggctcttgatgtgtttaaaattggacgaacttggattagaagttgatagcatatcaaaatagatgaaatcattcctgttaattattttgggcatatatttagacaaatcgttaatggaagcagattcatcggcattaaaaatttcttgaacaccataaaccccagacctaaatccttcccacttttcagcaaacgcatcctttggcggaaccagcatgtggaaaattgtatcacttaaactatccgttggcttttctaaaatcatgaccgaattaggttcattccaaccactaagataaaacaggtcgttttcctgttggaacggataaaatactgctccagatgcaaattggatatcgttaccagctaaaatcacacaacttttgggaggcaatgtttccgccaacctaattcttctttcatagtattccaaggctgaaatgcctggtgtcaactcgcccgactttataaggaacggccttgtctcatgcagtggttggcctgcctcaatggggattctgactctattagtaaaagtattacttttatgctgttccaatggcgataccaacttcgagaagtatctttggcaagattgcacagaaaaccgtactgggtttatcctatgtaacatatcaacagaaaatgaccacttttcctattagctttttctattatattctttagaattggtggagtttcttgtgcaaacgatccacttttgcagtgcagtaagtgatccctataccaggtgagttgatatatatttactgtatcttgtactattttatgaacaagaaaggctattactcacaacagttttggtttcagtcaaagtttatgtgtgagtgtgagagtgaatgtgtgcgtgttgcataattgcatttggcctttccgagaaataagtcattctttatttttctctctttacggtttaatggtgcggctttcgtatctgcgtctcatccttcccccttgccgcttgtcagaactctctagcttggcgattctctatcaacctgttattccaattcttatatctaccattaccttccagcattttttcaaacgtgttcacacgccctgtaacgtttatatataaatattttaatatttaacttagcttatgcatatatagttaaaagggataataacaataagaataaaaaacacaaactgctgagataagaaaaggaagcgaatagttaataatgcctgattcatcacattcaataagctcaaaagatgttgcatctgccatctctctctatgatcagtccatttacactaataacaggtctactaacctggacttagatcagagatcaatgagcccttccaatattgcctctggtgaagataggataacgagaacgaactcgggttgctccatcacatcaggtgcctccatgattgccacgaaggatggtattcaggggattaatgtcaaaagagatgggattccgaaatattcacttaatttattgaattccatggttcgaaaacaatatgatcacaataatggaacaaagtctcctaccccgaagactagcaatatggtagaccctaagaacaaaaagaagaacaaaaaaaagaagaatgacaaggatgacaaatacaaggtatcgcatgatcaaaccgaaaagttttacaaactcaacaccacttccaactccaatctcacctctgattctaatacttcgttatcggaccagttttatttccagaaaagtaacgctgattctgctccattagacaatgcaaattacccactctccgaccattccccctccctaaactctatggataatactacaaagcatagcagcaatgtgcacacttgaatcacgtgaaccacagtaacctaattgctcaaattttgagagttaaaggaaagaataaaatatataaatgatacgtttatacccgctaaaaaaaaaaatataaaacaaaaaaaggatctcataagacgatttgttgggatatgtccacatctttcggctatatactacatttagctgtttcccgtttctttgtattattcccttcttatgtataacttttactagtaataattataataaatattcgttttgaaacatggtaatttcaaatgttcaatgtattttcgggccgattgctgaccagcgacactttaagccgaactgtatttagtagactcccttttctcatcagcgaagaagaagtagcaaaagctgtttagcaagcaagacagcaatacgaagaccaagcatgattagatacactgttgctggccattccagaaggtgtgtagtaggagcttcgaaaagagtgggtgcaattaaatgtatcaccgtcgccaccaccaagagatttatctccaataagccaaacgaagtttttaccaagctaacgaatgacaatgatccaaagagagatgcctttttcaaatatacgtggggctcatggcttaaaaatgataagcaagaaaaggaaaaaagattcacgaagttttcgattgaaggtttaaatcgcattctcaatgacatctacattcaatctaatgaaatggctaaggcccccgacggtaagatcttaccaccagtgttcaacaagaacttgaccgtttcattggtcaataacgttgtaccaaagaatataggtaaaatcaacccaaatgaaaaagttcaagtaaccacattatctagtattcacgaaggtaaacatcacagaatatacaaggtcgacacgaatttgaacaaggcatttatcttgaggattccttatccgctggaaaatgaaaacactctatcctacagaataagaagtgaagtagcaaccatggattttgctgacctgaagttgggcatcaaggttcccaagattttttgttatggtgtcaattctttgaaccctgtaaggcagccttttgtcttacaagaatttatcgaaggagaactcttgatgaaagattgggatccattgattgaagacggttcctccaatcaaaaaaaatatgacaatgttattaaacaagtttctgattttcagtcgaagttagtgtcattgaaattaaatgcatttggatccatatattttaacaatgacttaaaagacggaaatgagaaggagtttgttaaggaagacatatacgatggggaaactaatccggatctacaaaacagatggaaaattgggccatccgtggaaagatgtctctggagacataaatctcacttggattttcataaacaaatgaaaccttttttgggaccatggccaaagaagtcaccaatggatataattaaaaatactggcctattggaagctgaaaatgctaaaactagaatagccttgaaagaggcaggaagttcagctgaattgatgtatcctcgaactttgaaggagcaaataactacctatgaaaatttagccaagattgccccggatttattcaacgtcaaaacaaaggccatcccaaatatgcaagaactattgtcaccacgtttgtttcatcctgacctagaccccatgaatattattgttaacaaagaagcacaagaagcctatctattagattttgaaggtgcatgcacaaaacctttcattttacagaattcgccacaattcatcgcctatgatgggcccaagatttatgacttaaaggaggacataaccgattttgacaaattatctgaggcggaaaaggcgcaatatcagttcatgtacaagcgcacccgtaatcaacatcaatgggagaaaaaattaaatgacaataatcctaaattaatcactgcagttgccccacctgttaagctactgagaagcccatatattgcagctgtcgaaagaaaaacggaagaagagtatttacttattgatgaatcactattgcaattgaaggaagtttgggacatctttgcccagaatgatttagtgaatcagaaaaagtttcctctaaactatagtaaagaagatattgaaagacatgttgaggatttgcaaaaattacacgaaaagctaatctctacaccatttgctgccactcaagggtggattcctcaagatatgtttgatcaactattaagttctggcagtattgttaagcaagagaacggagactacactgtgaagcaacctaaagctaccaaataatctatactaaaaatgaaatattttttcgttttctttacctcactcaactgtatataacgttataacaaaataatcaagttaaaacccttatttgtacacaatggaatctctcccatttactaatcaacttgacaatactggattagatatattgataacgttttaaaaagcgttgcgtgatgtttgggtgcaattggcggaaaagcggaactttcaaatttacgataggtggagatacatctccaccttcctccccattatctttgaattttcctcaaatatataaagagaacaacaaatccatagaaatgccattgtttaatcctgattatctacattgttttagttttttactcacaatcgagtaatgcctttgtttggccaagctatgtgcaaatatcacaaattaaaaatttggttaagcagttaggctggacctaatattttagaaaaacctaattttttttgtggacccattttcgatatttactcacaaatggaattcaaggggaacaacttcggtctcagcactttaattattcttctcgttcccacctaatttcgcaatttattgtccttgacttctaccacgagaaaaaaattaagaaaatgcaacgctgcccgtgcagggttttctgagcgggatgaaaaaaatcagacaaatatccaagttatgagtaattactttgttggaaggagggagcagagcataaggaaattcttaaaactgttatgtatataaaggaagaaccatttctagttatttcactttttgatacttgtcaactatcttagtaaaaatacagaactctataaagaaccacagaaaaatcgacagcaatgacaagcattgacattaacaacttacaaaatacctttcaacaagctatgaatatgagcggctccccaggcgctgtttgtacttcacctacgcaatctttcatgaataccgttccacagcgcttgaatgctgtaaagcacccaaaaattttgaagcctttctcaacgggtgatatgaagattttactactagaaaacgttaatcaaactgctattacaatcttcgaagagcaaggttaccaagtcgaattctataaatcttcattgcccgaggaagagttgatcgaaaagatcaaggacgttcatgctattggtatcagatcaaagactagattaacttcaaatgtcttacaacatgcgaagaatctggtttgtattggttgtttctgtattggtaccaaccaagttgacttagactacgctaccagcagaggtattgctgttttcaactcgcctttctccaactcaagatcagtagcagaattggtcatcgctgaaatcattagtttagcaagacaactaggtgatagatctatcgaattacataccggtacatggaataaggttgctgctagatgttgggaggtaagaggaaaaactcttggtattattgggtacggtcacattggttcccaattatcagttcttgcagaagctatgggtttgcatgtgttgtactacgatattgtaactatcatggccttgggtactgccagacaagtttctacattagatgaattgttgaataaatctgattttgtgacactacatgtaccagctactcctgaaactgaaaaaatgttatctgccccacaatttgctgctatgaaggatggcgcttatgttattaatgcttcaagaggtactgtcgtggacattccatctttgatccaagccgtgaaagccaacaaaattgcaggtgctgctttggatgtttatccacatgaaccagctaagaacggtgaaggttcatttaacgatgagctaaatagctggacttctgaattagtttcattaccaaatatcatcttgacaccacacattggtggctctaccgaagaagcccaaagctcaatcggtattgaagtggctaccgcattgtccaaatacatcaatgaaggtaactctgtcggttcagtcaacttcccagaagtggcattgaaatcattgtcttacgaccaagagaacactgtgcgtgtgttatacattcaccaaaatgtaccaggtgttttgaagaccgtcaatgatattttatcgaaccataacatcgaaaagcaattttccgattcaaatggtgaaattgcttatttaatggctgatatctcttctgttgaccaaagcgatattaaagatatttatgaacaactaaatcaaacctctgctaagatctcaattagattgctatattaatatgcaatcgattctcatactgtcaggtttttgaacatgattaaaagtttcctataaaatattaaaaagaacaaaaaaaatggatagaagaatgcttgaggcattaataatgattatctattttatatatacatacataatcatttaagttttttttttttaaagatatttcgatttagccgaatctgctcaatgcctcttcgatgacatccttgtggtcttctgaaattaggccttgtttgatttggtggtttcttttacgaatatttttctccttatccagttgtttctgtactcttaattttctttcatcgataacgttttgagtctttttacgcaaaaaggaacgcaaacccgaattcttacctttcacatcaggttttacatctggaatgtcgctgttggttttggctttattattagcatccattgtagtttgcgccaaatccttagcgtttaaccttatggtagaagaccttttatccactgaaccgatggaattcggatctaaagtaattgtatctgctggcagtttgttcaatagggttctgacttcctgttcctgtctttgttttttggtttcgaatgggtttaattctaaggcatcgtaattggcttcacctgcaccaggtacaatcaaattcgtaatacccgtttgatggcctacacctagtaaatcttcaaatggtacgaatcccaaattttctactttgtttccggcaaacaaatgtgacatgtaaggggtgtttctatgtgggttccctcccatggacccgaagcacggtttactgtctccacttaattttaaagcgtccttccacaacgtaacgtgagggcccctagataatgccaatagaccagtatctgaaatggaaacgtttgttcctggcgtcggtaagctttccacagaatgtagttgcttgaagtttctgatatcccaaattttcatcgacctatcagcccctgtggttgccatgtaatacccgcttctatcgatagcaatgctgttcactggtcctctggcagaaagtaattttactaatggttcaggcatggatggtgaccagagggatactgtaccgtttgaatgacctagatgcatcacagcattccatgggttttgtgccattgccatagttggcccagctttggtcctcaattccgagaccaactggccagtggaaacatcgtggtacttcaaccaacctgtctcaccggcagttacgagcaggtaatgatatggtagaaagtctaaatgtcttgcctcaatatgttgtttcaaacgatgtaattctgtaccttcgtgatcataaataaatgtatattttttttgcgctacagcaaagtattgttcgttttgcaaatatgtcgctgagtgacaggtttcattcaaaaacagctcagcacgaagttgtccctttctccagtccatagatgctacgtgacctttgcggccagtaatcaaaagatgcgtaccgttttttgcatattttatatgataagggccgaattccttcaaagataaatccaaagctttgtttgcagtactgacatccacactcgacttgatttccgattgttgcactttgaaagtcttttctagctcattctcaggttccaaataaccattggactcgggtaaaaggtaatctgttgccgcagcagaagataccgcctttttatattgctcgtctatttttttcaagcctgctcttagttttttatcctttgtttgagtatgattatttttagcattattagtatatgtggaacgttcaaatttattctggttttctctttcttttatctggcgtctgtgaccgttcttcttgtgacccattgtgtcgttggaatctggttctgtttcttaaagctaggatactgagtttttaatgctatatatggatttttttttactattgaactccaattcagtttcttctatacatcgatttttcacgaactcatcgcttagaaaattttcttaccgtttttctttttttttcaattacctgaaaagaaagccgggaataatgtcgggttatgagaacaatgtattatattactgaactatctagaatttataagtacgtcaataagcctaagacaattagcacaaacgaaatgtcagtaattagcatggacaatagatcccagtattgcaaaagggtaattagcttccccttcaggttggcgacgggaattactccctcgggcaccagtgaaactaacttgacaagtttattggtatcttgtaaatttttaatcttgctcttgtgttccacattcttcaatagctggtagtagatggatatggaaaggaactcaaaggtggcaaaaattctagtgaaattcgatgggttccgcaaaggtgcaaaccaagctgattgagtaaatgcataggccggccacacagaggaatttggtcttgtgattaggtatagatagggtagtaggaaaaagacccacttcacaagaatggtccaggctttcagtctgttcagcaagtaatcatggtagtccaaagcagcttgattgatcggggctgcaggagccgcttgaccaaacgatggtgtaccctctgcactgggcatgccagtgttcatagaacttagtagtgagagtagatcgggcgtagaggagtcctgaggggtacttttacccgtaccttggccttgcatggcagcgagctgtttcaataggtccaattggggcgctacgttgctatcttctttgatatctggagtagccgaatgcacactcgcaggtggtgtggtctttgcagcgctaggagcgtctaaaggtgattctgcgttcaaatgactgcttgcctgcccggtgattttattaagcctggagctggcacctccattgctaaacttcttctgtctcctttctcttagtaatctgcgcttttccgcctctgttaattcagacatatttcctagagctacgttgctgatgctgcaaacatggaagagctcatctgtacatatccatatcattcaaatcttttcatgttcctattcttgttcttttgtcccagcaaacgcgcacggcggggtcaccccaaatttttatttaccttatgttataagagcaaccatctcatccccaaacttctccctccctcccttttcacaaagagagtaatgctcaacccaagtagccatccgccttccccggattttcccacaggatcttctgcaagtcctagggtcaaactgagaccatccacgttgtgggcaccaccactcacagtatcctctgcctttgcggcttccagtagttctactgcccctgtcaccgtcacagataaacctgtcacacccgctgtatcaaagcggtatcaaccttaattcagattttcaagaaacagaatagcacattctctaacatcaagttatcataccaatatataacacaaattatgcataaatagataagtaatatgtccctctgcccctgcctttccctttccagatgctggcatcgaaagtaaggcatgtatttgtatgtaagttttttaattaatagtcttcttctttcttatcagtcgtgctcttctttccaaattaataggtttgaatcttatcggaatcacctggaattcgttctcattacatggccgcccaccatgcacctttacatttcgtatttctttcctctctgcgctatatctttgggaaagatttgcaatcaaggcaaacacccgcttgtcccctttcaattcttgtgttatttcaaaaaccatcctttcataatatatttgtatttctttcgccctggactctaccagttcatatttagaaccttccacatatcgtccaattctgcagcccacatctttttccaccacgatacgggaaacagaatgagtccttggattctcgctaaacagtctctctattcccctgttcaaaaccctcaagatatttgtttcccgcaacaactgcaattgcaattgatcaatcctatgcgaaaatgccgagtttatgttattcaagacgcattttaaaaaattcactagcggctccttgaaattcattatgtctgatgaatatgaaaaccttttattggctagcaagactctttaactcttctctctttattgcatattatctctgctattttgtgacgttcaattttaattgacgcgaaaaagaaaaaatatgaagaggaaaaagaaaaagcgcagcgggtagcaaatttggaatcgcataaaaagaaaaaaaaatatcaaagaaaaagagtcatctcaaacatatgtctgcagttacttcattatcagctttgaaaacttttgttgttgctgctttgagttctttcttgtgtgagtgctacaagccacatttaaactaagtcaattacacaaagttagtgatgtcagctactctactaaagcaaccattatgtacggttgttcggcaaggtaaacagtccaaagtgtctggattgaaccttttgagactaaaggctcatttgcacagacaacacctgtcaccttccttgataaaactacactctgaattgaaattggatgagctgcaaactgataacacccctgattacgtccgtttagttttaaggtcctctgtatacgatgttattaatgaatctccaatctctcaaggtgtaggtttgtcttcccgtctaaacacgaatgtcatcttgaaaagagaagatctattgcctgttttctctttcaagcttcgtggtgcctataacatgattgccaagttggacgattctcaaagaaaccagggtgttattgcctgttcagctgggaatcatgcccaaggtgtggcctttgctgctaaacacttgaaaatacctgctactatcgttatgcctgtttgtacaccatctattaagtatcaaaatgtctcgagattagggtctcaagtcgtcctatatggtaacgattttgacgaggctaaggctgaatgtgccaaattggctgaagagcgtggcttaacgaacattcctcctttcgatcatccttatgtcattgcgggtcaaggtactgtagctatggaaatcctaagacaagtacgtaccgctaataagatcggtgctgtctttgttcccgtcggcggtggtggtttaattgctggtattggtgcttatttgaaaagggttgctcctcatatcaaaatcattggtgttgaaacttacgatgcggccactttacataattccttgcaacgcaaccagagaactcctttacctgtggtgggtacttttgccgatggtacgtctgtgcgtatgattggtgaagaaacatttagagtcgcccaacaagtggttgatgaagttgttcttgttaacactgacgaaatctgtgctgcagtaaaggatatttttgaagatactagaagtattgtagaaccatctggtgccctttcagtagccggtatgaagaaatacatctctaccgtacatccagaaattgaccacactaaaaacacctatgttcccatcctttctggtgctaacatgaactttgatagattaagatttgtttccgaacgtgctgttcttggtgaaggaaaggaagtcttcatgttagttactttacccgacgtccctggtgcgttcaagaaaatgcaaaagatcatccacccaagatctgttactgaattctcttaccgttacaatgaacatcgtcatgagtcctctagtgaagtgcccaaggcttacatttacacttctttcagcgtcgttgacagagaaaaggaaatcaagcaagttatgcaacagttgaatgctttaggttttgaagctgtggatatctccgataacgaattggctaaatctcatggtagatacttggttggtggtgcttctaaggttcctaatgaaagaattatttcatttgaattccctgaaagaccaggtgccttgactaggttccttggaggcctaagcgattcttggaatcttactttattccattatagaaaccatggtgccgatatcggtaaggttttagctggtatttccgttcctccaagggaaaacttaaccttccaaaaattcttggaagatttaggctacacttatcatgatgaaactgataacactgtttatcaaaaattcttgaaatattaaaaccgacaatttactttataaatttacgcaacaacttgttaggtaaaatgaacgtcgtcataatttaaatactagacagcgcatgtatgttactcatatttatactcatatcatgtgaacctataaaccaattcaatacaagatttttacagttctcttgttttcttcttccagttttccccttttatttcctgtagaataaacttaaacagtgatcattaatttataattttctgctttgtaaatacggcggtaatggatgaacaaatgaaaacaaggtttgaaacatagacgtaaggattttatacttctttcaaaaccactaattgaccaacgcctttttttgaggattgacttcttccacatagccatgttgaaatatcgtacattgtctcgatcatgtcatatttttcacccaaaatctctttcaaacaataccctgaaatctgaaactactcaggaactacttcaaactgtgggattcgtaagacgctcgcaggttgggttgttccaatggctgccacttggactcagatcacttaataaagtatcaaatgctatacggaaccgaatggatagcgatggtggagccatagaagtttcattaagtgctatctcgtcaaaagcattatggcaagcgacggatcgctggaacaacagtgaattatttaaattgaaggattctaaagggaagcagtactgcttgacagcaacatgtgaggaggacattacagatttaatgaaaaactacattgctagttataaagatatgcctatcacaatataccaaatgacaagaaaatatagggacgaaatcagacccaggggtggtatcttacgtggacgagaatttttaatgaaggatgcgtattcgtttgctagtaatgaagaggatgcgtttgccagttttcaaaagctagatgatacttacaataagatattcaaagatctgaaaatcccctttgttagtgcgtgggcagatagcggtgacattggcggtgagtttagcaaagaatttcacctgattcatgaatccggtgaggataccttgatgagttgcaaacattgcggcgatatatcaactttggatatgtcccagtcatatcctgaaaaagatggtcaatattcaggtgatgtcgattgtaagtatgctttgactaaggatcactcaacattgatatgtttctactatccaaaggatagacaattgaattggaatttagcattaaatgctatggataaagacatcgatttgacgttgaggaacaaaccaaatgatcacgtcttacaagtctacgaaaaagataacgaagatattatgttcagtaaaatattaagagttatggactgtagattgaattcaaaatccaactttcctgattttccactaaagaaatacctgaaaaataattttggtcaaatcagtgacgtttctatagtggatgcacaggaaaacgaaatctgtggcaaatgtgaggaaggaaggttagaacctctcaaaagtattgaggtaggccacatatttttgctgggtaataaatactcgaagccgttaaatgtcaagtttgtcgacaaagaaaacaaaaacgagacatttgtccatatgggttgctacggcattggagtaagcaggctagttggagcaattgctgaactagggcgtgattccaatggatttagatggcccgctataatggctccatacaaagtatcgatttgtactggaccaaataatcctgaaaactcacagaggttacaggatgttaaatcagagctgctgaatgatcctaccatgcaaaatttacagaatgacatccttgaccagtttaatgaaaaactgggtataggtgctagaataaaattatcgcatgccatgggtataccattatgtgttatcgtgggctcaaaaagttggcccaatgtggaaattgaagttcgtggcataagatggggagaaaaggacctgtggagaaagcagtttgaaaaaagatgtagcgaactgcaatggaagtgcaccaaaaatgaacatggaattgagaaacatactgttccaatccagcatttagcggaagtcattggcgtattgctaaaggatatgtagccacaaagcaagccatttccgtcttgtatacatgtatataacaccaaaataaaaagaaccatgaattgaaaaacatacctcgttttgtggaagtaagtatttagtgtattaaagatatatacgtgcttctatagaaacttgaatcaaaaagtatcgtggacgttatccgatggcaagaatttattcaaaacaaggcaattctcgcgttcgtttgctcgtagtcttgttttgtcaaatagggtggataaaagctgaatcattactgaagaaaattcttaaaataacttaccggcaactttagaaataacatgtaatgcaacaacagaaaagatgaaaccgaccgctagaaacaacacaactaagggatctactcttagtcccgtagcctcatcagaataaatcttcaaaatcgaattattgctgttcgtgtttttctttggagcggatgccgcaactttttgtgaacttccctgttttctcttttgcaaagtacgttgaccacctggaggagttgggcttgacattatggagtatggtaggaggtagagtgtggtgttttgaagtggtggttgaaatcttttcccttcatcaaaaggctaccgtgtattaaaataaaaacacgattttttatgatgctttccttttccaatgtgaaaagttcagggtaacgttgtttgcgttccacgaaaaaaatagttgaagcggaaatgaagaatggatgaatacgtcatataaaccaaagaaacttttatacttttaaatatgctaaactatagaaatttaatgaacaagcccgctaaattcacgtttttctttttgttgttgatatttttttatttttattttttttcttttcaagttttcccctcacagcatatccttgaagatagtgtttatgcttggcagcggactgttgtttgtggtagtagttgtagaactagaatggtttatcatgttattggtggtttcggtagtgatggatgtagttgtggaagaaggttttggtctgggagtaatggcttcagaacgaaagttgtttaacaaagcaatatcttgcgggtttttggaattaggggtgcgattcatggttgcagccgaggagctggtatcggaggttatggtgcacctagaaccagcatcagaaatattcgatgaatcatctgcgggatccggtgaaaagatcggatccggtgaaacgtctttggaggatatgttggaactgctggatgaaaagacagtcttgttactggattgtttagcacggtgcagcgggtctacattatcttcgtcatcatcgttactaccatcacccataacgtcctctttgtcgctacctttgtcatcatcagtggtagaaccagttttgaacattcttggacgagttttcttggacagagttttttgaggtgaatgtgtaggagacaacatatccgcatcacttgacaaggcgtttaatctccattgaatttccacctcagttctctgcggcaaaagaatggatagttccataacggataggtttctctttttgttttccattagcaaagcgtcttcatcttttgaccatagattagtcggattacacgatgacttcatagaatggccagaaaacgaacctcgtttagacttatgcaaagtggatgacgatgacaccgatgaagaatgtgggagatccataaaggtataagagttggggaaaatgggcccgttgttggaggtagggcctccactgttacttaagttgtttaatctttgctgaaattccttcttgatgacagattcccttcttgagttggtattagaagtggaagcagttttcctgccgctattgttgacattgaatatgtttgacacggaatttggtgccagaatcattgaagaccgtcttgaagtgttgttgcttgaaatattaaacgatgatcttctggaccaattcgcaagcgagccccttcttgactttgagctgagtaagacatgcgaagagtttggagaagacggagtagtggttattgctacctgttgcggataggcaaacgaacttcttctggatctaacgaatactttaggaatgaatccatacttctcctcatcattagaccgaacgatggggtcttggttcaaagaattggtgaaggagtgagagtttgacctcggctttagagtcttatgatggggatggtggtgtaggtgttgatgaggatgatgagggagtgcggccggcagcgtgggaggagcgaacggcatggaagaagcagcgtttgagacaatcgtagtgggagtcacattggacggagattgagaaaatgacatcgatgcgtgaaacgaaggcaacgaggtctttctggagggaatcgggatggatgacgtcgtagtgaactcagcagtatcttccgttaatacgttttcttctaccttcttgctgggcttttgctgagcgtcggtagtctcatcgccgtgggtgatcttgagtgggcccgtataggtgttgatgtcgatcaaagcagtcttgttcgacttcaagttaccagacttcaaccttctccatctgaactgacacgcgttaggagtcctgtttgggaagtattgcgaaatatccttccagcccattttcttgacctcctttaaatgacgtagcagcagatcatcttgagggtcccaagaggaagggttcttgctcgaattcttggaagacgcagatgccgatgccgaagtcgacgatgaagaggaagctggcagagagggcgaagattcctgggtttcgttcttggacatagctgttgacgacgagtgtggctgacgagtgagtgagtgtagctgaggatgggtgtccatgctgctcaaatgaatggaagctgagttcaaactggttgaaatggacatcacggagcagagaagggagggaagactggaacgtgcacggaagctattcgatgaggtcggatgaattgactgtaaaaaggaggaaacacggataaatatactacaaaagagagaaaaaatagaacaagataccaaacaggacgaaagagagaagaaatagagatgatgcaaagtaaagaacactcttcaaaacctgtccctgtttttgttgtactcggtttttttcctttttaaactgtgtgcactttctgattccgtcttgtcgaggctgttggagaaaagagtagcacacacgacgataacaatagatacggtagattggatggggcacagatgtgcaaggcaatgcgcgaatcctgtctacgatgtctgtaccgttcatcctttctcctttgcatcggaaacatccgcgctgtctaccttaggaggacctcatgggacgggcgctggggactcgtgcccatccgggacttggggtgagatttcacaacggggccgttgctggtctcaccctctggccgggccggtccgtttttgtggcgtcgctgcaggtaaacgcgcagtttctgcgcgtttacccctgaggtgaataccatcttcaagcgtcaaactgcatccggataccctgctgttggtagcgatggtggtggtagtggtgtatgctcttggttctggtggtgtcttgtgtcttctcttctctttctgttcgttcggttcgtatataggtatgtatatataatgaaggatggaagatccttcattgcaagtgggaacggccggccttgtggtcagtgttactgtcattctcgggatgggaggaagccgggtcatggcccatggtttggagcagttgggccaaggcagactggggaagagtgtaggtgactttgttcccgttgctgtctgtcttcactcctcctgtagcaccaagtagcgcctccaaggatgctagatcaatggggccggaggtcttgctcttggattggctggaagggtcaagattttctgcatctgtgtcagcgtccgtgtcgtctatgtccattggatcatcgttatcggcggcagtcaccgaggccacagcggcttcgtggtcgcgagtgaatttgtcctgaggtttcttcgtagtgatagcgaacacctgttcgtcgttacatttggaaaaatcgtagtaactaaacacccttcttctcttgtctgcaaaagaacgcactgatgtgcggtgggccttggacttcatacggtcgctccattgagcgacgtcttcaccttctttcagcagcgcgacaaccactatactcatgttgtcgcatccaatacccgtcccctctgtggtgggagcacaacagacatcgatgatccgtgaagaaatttcattcaatgtcttgccttcgcgaaggccgagatgaaccaagtccacacaatcttgggaagtcaaacaatcccagataccatcacaggctaagattacaaactcgtccctatcgtaatctagagaatgctcgagaatgtccgggacacatgtcactatttgctcctcggggcccaatttggggttggatttgaactcaaaatcaccaatggcacgagagagcgccaagttaccgttgaccctatccatttctacgaagccatcagctgccacaatacgtgatttttcgcttgctagagtgggcttgtgatcgtatgataatgcctttgcgttcccgtcggtggcgagtacggttctactgtcaccagcgttaccacacaccaacaagttctgggactttgatactaatatggatgtagccgtacatccgctatggtcttctttcatcacaggatcttgtaacagtttcacgtctgtgtttatgaaagtatcaatcaaagcccttggtaaatttccttcatggaacgatttctgctcttgcaggatctccactattttattaccacagtattctgctactttagcgccaccatgaccatcgaatataccgtaaaatgcaatatggtccttatcggactttgtcaaaacattaggctctagaatgtgtgaatcctccattgacatccgccacccttgcattgcacacagtccaaacgcggtcaacgagtcagcaccggagtggctctctttatcaattaccgggtttgatagaatttgtcccatttttctttttctggttctctatatgttatacaacaatggaatagtcaaaatcctagggatgttattaatcggaaaactactatctcgaacgaatagttataattaatcaatgaaaaaaaaaagagaaagtaaaaaatgttacaacaactaatatacactaattgtccttgataacagaacttgttgtagttttattccgtggggaggagggtgaattttttttatttagttttaaagaacaaaacagaagtctatatacttagcactataatatccagtttcaatttgctctgtcagaatccgaattggctggttttctttgttttaccacccccttccatttatcagcatgatattttttttttagaataatcctttcaatcgttgaagtagtttgtgggaaaagaaaagttgttaaaggcattaacgtacacagtgatttgctgactcattacgatttttcactcatcgaagtattgttaaatttcgatatattaacatgactaaagggctatggtccgtcgtagcagaaggcaatcatcactttaaaaccgaggccacaatcgataattagcactgatattctgattggaaaaaaggcaaaaaatgaccgcttccatcaaaattcaaccggatattgactctctaaagcaattacagcagcaaaatgacgatagttccataaatatgtatcccgtgtatgcgtatttgccatcattggatctgactcctcacgtggcatatctaaaattggcacaattgaacaaccctgatagaaaggaatcatttctgttggaaagtgctaagacaaataatgaattagatcgttattcattcataggtatctcgccacgcaagaccatcaaaaccggtcctactgaaggcattgaaacagatcctttggaaattttggaaaaggagatgtccacctttaaagtagccgaaaatgttcctggtttaccgaagttaagtggtggtgctattggttatatttcttatgactgtgttcgttatttcgagccaaaaacaagaaggcctttgaaagatgtcctaagacttccagaggcatatttaatgctttgtgataccattattgcctttgataatgtttttcagagatttcaaatcattcataacattaataccaatgaaacttcgttggaggaaggttacaaagctgcagcacaaataatcactgatatcgtatcaaagctaaccgacgattcctcgccaataccatatccagaacaacctcctattaaattgaatcaaacttttgaatcgaatgtaggcaaggaaggttacgaaaatcacgtctccactttgaagaagcatattaagaaaggtgatattattcaaggtgtgccatcgcaaagagtggcaaggccaacttcgttacatcctttcaatatttacagacatttacgtactgtgaacccatctccttacctgttttatattgattgtttggatttccaaatcattggtgcatctccagaattgttgtgcaaatcggattccaaaaatagagtcattacccatccaattgctggtactgtcaaacgtggggctactactgaagaggatgatgctttagcggaccaattacgtggctcgttaaaagaccgtgcagaacatgttatgctggtagatttagcaagaaacgatattaacagaatttgtgacccattaacaacaagtgtcgataaactgttaactattcaaaaattttctcatgtccaacatctggtttctcaagtcagcggtgttttccgcccagaaaagacaagatttgatgcattcagatcgattttccctgcaggtactgtcagtggtgctccaaaggttagagccatggaattgattgccgaactagaaggagaaaggcgtggggtttatgcgggcgccgtaggtcattggtcatacgacggtaaaacaatggacaattgtatcgctttaaggactatggtctataaagatggtattgcttacttgcaagctggcggtggtattgtttacgattcagatgagtacgatgaatatgtcgaaaccatgaataaaatgatggccaatcacagtactattgtgcaagcagaagaattgtgggccgatatcgtaggatcggcttaaaagggcattctctgtttttctccccttagacgacatttttatagttttcgaataatatgatataatgatgtatagcaggattctgaaaagtattattcttccgacatatacatttggtccgacttacaaccaaaaatttttgttcaaaaaatataggaaagtttagaaaacgaatgttgaatgcgttataaataatacagaatgtacgtgtatataaaaatataataaaaaaaatgcaagagttatggctttgtaataaaattgatatcaaaaaattacccaaataaacttttaaatgtgaacacaaaaattaaatcaccgatgttgaatcccagaataaaaaacaaaaagttcagaaaatatcattactttgcttcctttttaaaaccttaattcttgtattgttcacggaagtacttggcggcttcgaccatatgagtcaaagacaatctagtttcttcccagcctctagtcttcaaaccacagtctgggttaacccagaacttttcagctgggtagctcttcaagatggttgaaatcttggcgataaattcatcctttgatggaattcttggagaatgaatatcgaataaacccagaccaatgtggtttggatagtttttgaattcagcaatgtagttagcatcgtccttcttagagaattcgatggaaacaacatcagcatccaaagccttgatatggtttggatccaagtcagagtaacagaaatgagagtgtatttgagtcttgttagcaacaccagaagtagcaactctgaaagcttcggcagcccaggtgtagtaagcagatctctcagcaccttctctcaatggtaaaccttctcttaaagctggttcatcaacttggataaccttgataccggcagcttccaaatcattgacttcatctctcaaagccaaagctaattgcatagcttgagttttttggtcgacatcgtctcttgggaaagaccatctcaaacaggtaattggaccagtcaacataccctttactggcttagaagtgatggattgagcgtaaacagattccttgacggacatagcctttggtctggacaagtcaccaacaataattggtggtctgacatatctggaaccgtaagattgaacccaaccgttaacagtgaaagcataaccgttgatttgttcaccgaagtattgaaccatatcgtttctttctggttcaccgtggactaagacatccaaaccaatttcttcttggaatctgatgaccttttcaatttcagaattgatgaatttttcatattcttcagcagagatggtacccttgttgaatttgtttctgttaattctgatgtccttggtttgagggaaggaaccaatagttgttgttgggaacaatggcaagttgaagactttttgttgttcaggcaatctttgttcaaatggagctgctctagtagacattttttcgtcgatagaggcaactctggccttaacggcagcatcgtggataaacttggatttacctctggattcaacagatttagcgttagcttctagggcagcagcaacgtcttgaccggaaacgttcttggtgatcacaacaacttcatccaatttttgagtggcgaaagagaaaaagcccttgatttcagcgtccaacttggtttcgttgttcaagtcaactggtgtgtgcaatagagaagaagaagtggcaacaacgactctgtcagcacccaacttttcaatagccttgttaacgatagcggaagacttcttgaaatcattcttccaaatgtttctaccatcaacaataccaacggacaaggtttgtttgttaccaatggcggcaacgacttcatcaaattgttctggagctctaacaaagtcaacgtgtaaggcagcaactggcaagcccttgatggcgtctaagttagggacaacggtaccgaagtaagtagccaaagtaatctttggtagattgctttgttcaccgaagtaagtgtaagccttcttaatggcggcttgggcgttggcaggcaagtccaaaactaagacaggttcgtcaatttgaacttcagtggcaccagcagaagccaatttagataggatttcagtgtatagaggcaacaattgttccaatagggacaatggttccaaatctagagaatccttgtcagccttacccaagaataagtaagaaactggacctaacaagacaggtctagtgtgaatacctaactccttggcttccaaaaattcgtcaactggcttttggccgttcaacttaaattgagtggtcttggagaaagttggtctaacgtaatggtagttagagtcgaaccatttaaccatttccaaagcagtgacgtcgacagccttttcagtttcagtggcctttctttgtaaacctctacccatagcaaacaaagtgtcgattggagatagatcgtacttagtgtaacggtctggaatgacattgaacaacaaagacaaatccaaaacttggtcgtaaaaggagaagtcattggatgggatgatatcaacaccagcctccttttgcaacttccagttttgagttctcaaatccttaccgactttgaataattcatcgacagtgattttaccgttccagtaaccttcagtggccttctttaattctctgtttggaccgattcttgggaaccctaagacagcagattgaaccatttttgatatgtactttgaaattatattggtattttgtttcttagagtgttgtcaatgctcttagatgcttgcttttttatgataaaggaagagtttaacaaaaatattgaatacgtaaaagagaaactaatgctagtaaagatggaaatatctatcacttatatagaatttttttttctttcctttttttctttcgcagttgggaaaactagctagcttcccttaaattagtgcatctatcgcatttgttccatattcacattcacagttctcaattgagcagaacgagctatgactaccacagttttgcgaccgggagatagagcgaaagagctgccatgactgcgatgactctagcgaaaaatattgaccttttgcacgttcgcgactaaacgagttcgatagtagtcccgtttctggttttttccctttaccggcccacattttttcacctgactccggtcctgacgtacgactctgtttgtaagtcacgtgaaatattttcctgtggcttttactagtaatgtgcacgtgatgtggcgtgatggtcctttacccggagtgagggaccctggttcatgaaaaattgtgtgaaatcaactgcatttttggaagcgaaaaagatgatgaacctgagttgaatggctgtgggaaaccaatacttgactgattataaaacaagaaaaaaatgcctagtaaagatccagagagcgttatagacaaagaaatacggaagatatcagcaagaaatgatgagcttatcaaacaggatgggactttaaaaagggaatacactacattattgagaaaagtatcgagcgtgataacggtactgaacagtattgatgatgcagatactggttctgctgaaacggaactcccacgcttaatatctcaagcaacagtagagaaagtacccgaattgaagtggtacaatgatcagatatcattgattacagaaaagttggaggacgatgaagatattgaggttcccgaggagctaatggatgcttatactctgtacaaggaaaccccattattatataatgatacgcacacaccataatggttttgtatgctgtggtgtagggaagtgtctgggtctatggaatattgtgactatatacatttatacatgcggcccttttttgctctaacgtgtaaaattagccggccttttgtctcttttgttgtcgtgcctgatgacattttcaagcgctctattgttaataaatagtccgcaaagaaacttcctaacatgtggcttaaaccgatacttcgacatcatattaaatactttgaagaacattttctcgttttcaaaaagccttggaccgtatttattgtttatttctgtaatctccttcactgcgtgatttgaaaggatatgattgcctagctgacttactatatgtagtaccttgctctcgatggagtcatcgtcattgcggtattgtgtaacatagggagaagaaaggccttcgtttgcgaaaagactactattttcacctgaaacagtgatagtttgacttgtgatatcgttgtcgtatttattagtaatgattttttcatttaatggattctctgcggtatctttctctttgagtagtttgtccaaatcaaattcgatgggtaagcatttttctatcaagtcgccatcgcttttattaaaaacaatcatctcatcagaatactcgccaaatgcggaccatttgtgttcgttatacgatagaaatctatcgagcctatttggtagtgcgatcccgataggctcatcttgtacactgacacaacagttccatcccatctcgtctagaatttcgcaaccctcgcgggtcatgctgattaatcccagaacataaaatgctgtaaacctaacgctggttacgctggcattgtaggccacctcgataatatcttccaccaatgagtagttatctagtagacctatccccaattctgtggatccgataaacccaacacaccataatgctgcttttaagtggagaatttctttggcattttctactgtggccatattgtttccgttgacgtatttttttataacgttcatgaaagtaaccaaatctcctgtttggcttaatagtaatattccgtcttctgttttcgttagactttcgtaaaaatgcaatggcaggcgactcttttgttgaaatgtgagggattttgcattaattgattcatttttcttcaggaattcctccacaatatgaacatactcaatgttttttttagataaccacgaatccctttcctccttcacaaaattgatttcgttcaacaactggaacccgtatgggcggcttaataactcgaaaagtattggagacctaatgaataccatttggtttaaaaacatcctaaatgaggtgcccagctcttcagaaccattgcccgcgacaatacattcatataaagcttggtctgctacggcgactacgctggggctcaggtcgtatagttgccttgttaacatttccattttgaattgctgcagtttcactttattcgcttttaacttaagatcactttctttcgtggataacagttcttttagtttatcgcctatatgctttgtagcctcaatcctaactttctcattggccactacaagggccttgccgataatgacgcggcaatgtgatgaatatttcaaatctaattctggtattgttaataatagaaactcaagccccagtttcgattcaaattgaaacatcttatagattacggtaaaaaaattccacctcgttaggatatgaaccccattctttgactgcgtcaatattccgatgaatttgaagtatccaaatattattttttctcgtagtttattcttgttgaagatgttgcctgatatatttccctccattgctctaaacattaaagacgccagttgcggtataatttttgtatcatccataaggattttcattccttctggagtcgccgttagtgttttgaaaaactggcatccaacttgtacatacttttgagataattttgcgcctttattaacgttggaaaatctcaatctgagtggtctgtaaaacaccaaaagtcttctgatgaatttggttgatttaactagttcttctagttgctttttatttagtaatggtccttcaagtaattcgttaattatgttccaattccatcgcgtaaaatccttcgtttgcaaaactttagagtcataaaccattcttctaaatcggaaatcatctacttcgcggagaagagtattctctttaatatttttggaaaatgattttatattttgagcataatcaatgcccgacatgccaattgtattcctgtttctattcattttataagcgatcttcttgaactggaatgtttcattgacgtaagtgaagttctccttgtaaattggttttgatactgaagtatactttttatcgactaaattcattcttaaattaaaatattcggtaagaagatatctgccttttgctaccaagtgatcatctctatcttcttcgttcaaaagttcaaggaggtggggtacaaattccgagttctccagaattagcacaattaaggctagccgttgattcacagacatacactctttgtagtactgagatgggattggtttgaaagaatgagaatgtctgccccttggcttgtatggtaatggtttgattttcaaaacatcaagaaagatgtcgataagatattgggcgcatataggaatttggaagaatgacaccagctgttttaacggtttgaaattgttgttagaaaaaagcataaagccattgtagctgttcaaagttattgagataagtgtagaagcgttttgcattttttccacattaacgtttgactttgtatttgtatccgaaaagaccgtggttaacacagatacattgaaatcttccagaaaatgttgccttgtcttgtgtgtagccatcaattgtaaaatagtatcaagtattactgatgcgagtgaaaaagaagtataatcttgtaaaaatccctcgatcactctcataccacggcattctttaaccatttcaggggcgacaaaacaaagttccaacaaagtttctaatgccatgtgccttaaggagtcttcaggtttttcaacacagcttattatagcttgcataatgccttgagtaacaccgttgttgtattcaatgaatcttcgtaccatttttaaggcttgttccctttctatttgaaaagaagtatccttcgcaagggaaatgattatgaatgcatccagtcttagctctaacagctcatcaatgaaaatcgagctatttattaggtaacgacataccctataagcagatgctgctataagcttgtttccattgagaagcagattttgaattgatgacatgaatgaagttaaaaccagatcttttcttatctctgaatgttctttcaataaggtgaccaggccatttgctttttgagcaatgaaatcagggttgacgttcttttcttgaaaactttgcatataatcgcttacaagccatgttgctgcttcagttgttgtggatgtgaatatttgattttcgttttcaagatcaccaagatctttttcagtatcaccggttaagtttactttattagatccatctaaatctggaatggaaagcgtagaatgattttcgttattccgtgagttgacggtactattacgatttaagttctgctgactattacgctcagttccagaagtgggagtcgtaagatattcatcatcaagagtaacttgatctgtcaaactatcatggtcgtccaaatcttcactatcgttattttggccatcatcattcctgatgctccccacgtcagcctttattgagctggatgttgtgagtgatctttgccttttcttgtcgaactgttgcttgaggtcaaaaatatgcttctcaactctttttattgaattgtcaatttctctaagttgagtattggctctaatcctcatcgagtgcttttgtaaatgattcgtagagtaagatccagagtaaatatcagatattgtagaatcccgaagatgttcgatatcgtcttttttcttgcgcaatcgagctaattcttgatattggttgtttatttctgctttaagatttaaaagtgccttggtcatagtacttctcgttcgtcttgccattaagggactggtcggtgaaggcgcactattttctagcctcttggtggagataaatgaggtcgagagtaccagattttgtttatttcttttggaactttcattcgttatggttgatgggctgctggaggtgatgttcttggcgcttgatatttgggtgctcgagttatcacggctatgtctaggggttaacagtggagtagtattagttactgaccggcgccgacttgagagagggctactctgttttgcactgtgaggtatgctcattgtgaatttcaaaaacttaatagaagcggtacagcacgaagcaacctccctagcgtgtacacctacaaattgaaggtaccttagttatatccgagaataatagaactgcttgatattccatcttccatttcgccgatggatcaatcaatttttaagagaatgcaaaaaagaaaaagattacaatatgtataattaaaagaagaaagaatgtatacggatatacgatatgtgaccagccggcaacggctcgtagttataccattatttacagtttaaagagattaagccaatgcgtagtgctacttgttgttttcgctcgacaggaggtcttgcaattgcttggttagtttggaagtttcttcgtccatgctcgtgtcggtttctaaggcttgtggaacgcccatgaactctctagtcttaaatacaaactctcttgccgttgaaatgtcaagtgcccaacaaaagccgaatatcaatgtgctgaacgtacctattgaagcggcggatgcatacgttaacgctgacatggcttcattcctttgggaaaaaggtggaagcttgtaattttgttgaaatatgctggggacgtctgctttcagtaggcggtgttagtaactatatcctattattagtttttgccactgaactaggacaaaatacatacattttcgtacttttatggccctggagataagcctcatggtaatcagggtgaaggcggccgcaccataaaatctggccatttgaagaaccctgcgtttcttacgttccttcttctcttcgatcatagtttcgtttcttgatgaggtaggatagtcgtactaattgctgacaaacccgtcaaagaatcaagttccccatcctaataagtattaaaagcgccaatttttcaagagactcgcggctggtgaataacgctgctccttagaaaaggacagccagcggatagctactcagatcttcgactgactttatgcattttagtatttatatattcattcgatctattctgtttacttaaaaattaaagatgagttggatgtggaaaattcttgacgttccgctgatattttgtgttggggttttttttgggaccatgagattgccatgaaccgatcaatcttgtctcatcttcaagtatctcttcaccacttcatccttcttgataatgtatactacagctccccagcctgatagagcgtcacggtcagcagcattcagtagggcctgacttatagtttcgaaaagatcttctggctctagattaggttcgtacagggactcacacataccgaacagttggtcggatgcagtaccgctaacgataaaatccttggcctcgtcgatacagccgattaggtcgaatcccgcaataaagggcttcccggacttggaattaatacctgctaccaccggccccacaaagtatggaccgaatcttctttcataaagtgaacttgacactaattgggtaaacgtttcaggctcaatggtcctttcttccttcaacttatataggttcgtcttgtagcggaacatctcgttcagagtagtcacgtcggtagccagaccggtaatccctaagaacacatgcccatagtggaagattttttcaaacttgttcgacacacctagtgactggcttccgagacgcaaatcacaggcaatggctacacagtctttacctgtcatcgcaacgacgataccaccgttaatagaacttggatccgacattttttttatgctttattcactgttcaatattttcaccacaattcgcaagaaacgcactctacttcaaaactacggttcaaacttatttagcagcttcccgctttaattggcctttctactatgccataaactctttcttcctctcttttcatcgcccctgcatttgcacttttttgccaccggcagtgccatccggtcacatgactacaccacgttaatagcgatctggcttaccattgtcacagagtaaattaaaatggacggtaaatgttggaaatgcaccactaccgttcttcaaccaatctagtttagctatcctgcaacaggtggccttcttgagcatttcctgagcattccaaccggttgtatcagtgttttatcaccgtctcaccatatcccacgactaggccacacttcgttaccctatgctacgcgtcatttccgctatttctgtcctggtttgtttacagtacgcgtggtgggaccataaaggggaatagtggggactggagaaaaaattttctcagctacttcttctatcttccgtagtttccatatactagtagttgagtgtagcgacaaagagcagacgtagttatttgttaaaggcctactaatttgttatcgtcatatgtctcaagttcaagaacaacatatatcagagtcacagcttcagtacgggaacggttcgttgatgtccactgtaccagcagacctttcacagtcagtcgttgatggaaacggcaacggtggcagcgaagatattgaggccaccaacggctccggcgatggtggcggattgcaggagcaagcggaagcgcaaggtgaaatagaggatgaagcatacgatgaggctgccttaggttcgtttgtgccaatagaaaaactgcaagtgaacgggattactatggcggatgtgaagaaactaagggagagtgggcttcacactgctgaagcggtagcatatgctcccagaaaggatttattggaaatcaaaggtatatcggaagctaaggcagataagttgctaaacgaagcggcaaggctagtgcctatgggatttgtcacggctgctgattttcatatgagaagatcggagctgatttgtttgacaacgggttctaagaatttggacactcttttgggtggtggtgtggaaactggttccattactgagcttttcggtgaattcagaacaggtaagtcccagctatgtcacactttggccgtgacatgccaaattccattggatattggtggcggtgaaggtaagtgtttgtatatcgataccgaaggtactttcaggccggtaagattggtatccatagctcagcggttcggattagacccggatgatgctttgaacaacgttgcgtatgcaagagcctataatgccgaccatcagttaagacttctggatgctgctgcccaaatgatgagcgagtctcggttttccttgattgtggtcgattctgttatggctctataccgtacggatttttctggtcgtggtgaactaagcgcaaggcaaatgcatttagccaaatttatgcgtgctttgcaaaggctggccgaccaatttggtgttgcagtcgtcgttactaaccaagtggtcgcccaagttgatggtggtatggcttttaatccagatccaaagaagcctatcggtggtaatattatggcacattcttccaccacgcgattaggtttcaaaaagggtaaaggatgtcaaagaatatgcaaagttgtcgactcaccttgcttaccagaggctgaatgtgtgttcgcgatctatgaagatggtgttggtgaccccagagaagaagacgagtaggtatttggtctcttgtctctatttatttacacaggtttactttcaattctcctctttttcttaggttgcgttccgtacatttttatcttcatttccgtccactgtcttagatttttgcatatattttgtcatatacctcgcaaccctactgcggtcttaaccttttttttcagttcttttaaataactttcgtattgtctgtcacccatgaaatatatgtatttttctactcttcttcccgatgactacttcctcctgcagggtccgcgcggctttatccttttaggggagtgaagagaaaaattttctgatatgtcgccattctcttataaaaccaacgtaaaataccatacacttctttatggcaatgaatttccttgtcttcgtttcgacgttttaaattgaataaaaaattgtacttggaagaacaatacttttgctaacagcaagagaagtacggttgacattacgagtatccctttgttaaaatcaggcagtacccataatgtccatgactatttgctcaaatactcctggtgcataccctgaaattggagcttataatgaggttgataaacagttagaatcaagcggattctcctctgattcctctctgatattgaataaaccagaagttcgtcaatactggtcatccgtttcatctcatatttcacgctcaggtgatgtgtttacaaatgataaagaaaaaatttcatcctctattggtgaggatgcgatggatatcgacgcttcgccctcattgattgaaaaatataactcttttcccacaagaaagattcttcctgagcaggacgagtttgagaacgacgttgaggacgatgcttcttcctcactgaaggaaaaatcacaaggttcttgtgaaattgaaattgcttctgaaatttcatccgaaattttaaatggcacatcggcagacggtaattccgagtttcacgacttcgctgagccccctccctctcagaatgaatctgtcgctctgtcttttagtcaatcgaatgatttggactttttgaataatccaagcggatcaggctcttcaaacgatatcaatagaagcacgagttccatttcacttcctagacatgtgtcactagattttaacgtttacaatagtctttgcctcacaaatgaggtgactgcatcagaatcacataatgtggccaaatttcaccttggcaaggaaaacaagaagagcttgctaccaagatggaaaaccattgaaatgtacggggaggtagttgagaaaactcaagacatatattctaattttcagtatgcacaatacattttaagggtagggttggataccgaaaaactacacgaacttgttaaggaactggaggatgaaagcaatagcttcactgtagattctttaaaggaatatttagtgaacgatgccaaagttattttgaagaaactaagtgccgttggataccctgatgcacagtaccttctaggtgacgcctactcctctggagttttcggtaaaataaagaatagaagagcatttcttttattctccgctgcagccaaaagattgcacatcgaaagtgtttacagaactgccatttgctatgagtgcggcttgggtgtaaccagaaatgcaccgaaggcggttaactttttgacttttgctgcaactaagaaccatcctgcagcaatgtacaaattaggagtatattcgtatcatggtttgatgggtcttccagatgatattctaaccaaaatggatggttatagatggttgcgaagggctacatctatggctagcagctttgtttgtggtgctccttttgaattagccaatatttatatgacgggatataaagatcttatcatttcggatccagattatgctatggcattgtatgagaaggcggcggctttagggcatactgaatcggcaagaatactagaagacgctcgcagaagtggagggtttgtttcgcgaggacatcctccttcggcacagaaatatcataaaacctcccatgaagctgtggcagccaaaaagttgatttaatagataaatacaaacttcgttttccttttattttgttgtttttttttcacaaactgtggaagttcgattaactttagaagtttgtttgatcaaaaatagactgatcctcacacctttcgttactatttgttactttgctgtatatcgaataaataaacctgactaaacttcttctgttatttagcgcagatcctatatgctgcattttgagatgtatttgagcactactatcgttaatgccgtggcattggctatggaccatttaagtcacggcctttcttagttctatcatatacggcgttatacttatttactttcccagcgttgaaattaatgtgtctttttaataatatttactttttggtgcggaaatctgtaatattttaaaacaaaatctcatcctttggaaaagaaacaatgaagaaaaaaaataataacatacattatactttcactaacacttgtaaaacaaacgcttacattataatggcacaaatgagcaatcagtgtcacttcttcctacataagcataattcaagtatcgggatataaagctattatataccgcttaagataagaggtatacacctcattgatcaaatacgcaacagcgtctactttcagacctttgtggagtaatttctgcgggtaggattgactatttttcaagatcaatgccccctcacactaagacctgtttgcttagcatcataaatgagtttttccataattaaattccaaccatagattagaatttcgttgtgggataaaactccagaaccacaacgattatgcagcaaatgtaaccttgaactaaactaagattttgttagagcaggtggtttccgttactcagacaagaacctatagtagaaatataaaagtttaagtaaaactttcttggaataggaatcagccatcatctatcaactagtgtactgatattcataatactggtatacaatctgagatatatgtgggtaattagataattgttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacaatcatatacggtgcgggaagatgacataaaaaattgagaaacactcatcaaatttaatggaggccgaaatgcagggactcagatcgtgatagaataataaacgagaacatataaaatggaagaaaaaagaataacaacaatatgtagatttatcgattctccttttatggattccatatctcgaggagacttctagtatattctgtatacgcaatattatagcgtttacgaacaattaatcccaacagttattttaaaattcaccaacatctcaatatgtgttttatgaatattttaggtgggtattgtcatactgacgtattcgattttgagatgcaacacatacgtgtattgtaatccgatatagtgtaacggctatcacatcacgctttcaccgtggagaccggggttcgactccccgtatcggagtactttttttgacaccatacatacactgtatggtgttaggagccaccttccaacaaagcatcacgctgtcgtatctcaattgtccttcagcaaaagaaaaagcagttgggctcctgtacgccatatatactttatatgcggtttttaccccggaaatcgcgtttattaatgtcaatgcgcgatttctattatgggttgaaaaagttgcacttctgttcctttccaaacgatatgacgccccccccacaagaaaacgtttctcttgcattcaataaggtccatcgaagctgtatttggaacttccgattttattaaacttctaggggcgaactcaacctttcgcttgaacaagcctgaatgtgtcgtaaaccttagctcgatccttaaaaaagtatttgcattatcagtaataaacagaaaattaaaacatttaccaaaggcaacgagtcttccatatgaaaaatgataaaaagatggttatctgtgaataggaaaaagtcacacccagagaagaacacgcaaggtaatgacgaaattaatcggaaagcaactagcctgaagaaaacgaaaggttctggagatccctccatagcgaaatcaccaagtgctaagagtagtacatcaagcataccttctaatcttgcgagccatgaaagaagaagcaagtttagtagtcaaacggataaccttgcaggaaataaacattaccatgagcattaccataatatggcaagtacttcagatgaaagagagtacgattcctcgactacatatgaagatcgtgcgttcgatacagagtcctccatactatttactactatgacagatttaatgccatatggagatggttccaataaagtgtttggttatgaaaattttgggaatacttgctactgcaactccgttctacaatgcctttataatatccccgaatttaggtgtaatgtgctgcgatatcctgaaagagtagccgcagtaaacagaatacgcaaaagtgatttgaagggttcaaaaataagggtattcactaatgaaagttttgaaacatctactaatagcggaaattctaatacggggtaccaaagcaatgataatgaagatgcacataaccaccaccaccttcagcagagtgatcaagataactcctcttcttctactcaagaaaaacagaataattttgaaagaaaaaggaactcgttcatgggttttggaaaaggtaaatcgaactataaagattctgcaaagaaagatgataacaatgagatggaacggcctcagcctgttcacacagttgtaatggcctctgatacattaacagagaagcttcacgaaggctgtaaaaaaattattgtgggaagatcacttttaaagcaaagcgattccttatcaaaagcttcaactacagattttcaagcaaattcgcattgccaatgtgattcacaaggcagtaggattacatcagtggatgatgatgtccttgttaaccctgagagctgtaacgatgctgtcaacaattctaataataataaagagaatacgtttccaacaagtgaacaaagaaaaaaagccgccttaattagaggccccgttcttaacgtagatcatttactttatccaaccgaggaagctacactttacaatggactaaaagatatatttgagtctattactgaaaacttgtcactaaccggtatcgtttcacctacagagtttgtcaaaattttaaaaaaagaaaacgtcttgttcaacactatgatgcaacaagatgcccatgaattcttaaactttttattaaatgatttcagtgagtatattcaacgcaataatcccagagtgagattcggaccacaaaagacagacaacagcaacgacaactttataacggatttattcaaaggtacactgacgaataggatcaaatgtttaacttgtgacaatatcacctcaagggacgaaccatttttagactttccaatagaagtacagggtgatgaagagactgatatccagaagatgttaaaaagctatcatcagcgtgagatgttgaacggggttaacaaattttattgtaacaaatgttatggtttacaagaagcagaacgtatggtcggactgaagcaactgccccatattctgtcattgcacctaaaaagattcaagtattcagaggagcaaaagtcaaacatcaaactttttaacaaaatactctatccactaactttggatgtttcttccacttttaatacatcagtatataaaaaatatgaactaagcggcgtcgtcatccatatggggagcggtccacagcatggtcattacgtatgcatttgcaggaacgaaaagtttgggtggcttttgtatgatgacgaaacggtggaatccataaaagaagaaactgtgttacaattcacaggtcatccaggtgatcaaactacagcctacgttttattctataaagaaacacaggctgataagaccgaaaatcaaaatgaaaatatagacacttctagtcaagatcaaatgcagactgacaataacattgaacagttaataagatgcgatgattggttaagggatcgtaaattgaaggcagctgcaaatattgaacgcaaaaagaccttggggaatatacctgaagttaagactgcggaaaccaagacgccattaaatgataaaaaacgcaataagcaaaaaagaaaatcgagaatattgagcttcatcaaataaattgggattgtttcgatacatcatatagttgagacccatctgttctaaaagtatcaatattagtgtaccattttttcttccttttttaaataatttccacgtttctttctattgttcctgatctttcgaatttagttgtatttcatttcacctactgtaataacttttttttttagagcacaataaaatttcacatattttccaaaagcaagggcggtaaatcagaaaagattaagctttaatgaaaatctcatagagaccagatgaagaatattggtggcagcataagcgctaatactgaatagatatacgcatttttttcaaaatatctgttagtacaattatacaaatatattcgtttatacctcttctttaaacaggcgcatgtgtaaataaatatgagactgattctccattatgcaatcttctgatagcttctgcaatcgtagggctgatatccacctgatcgacaatgtccaaatccaaatcaacaggtaccgtgttggtgcaaacaattcttgataacctactatttattaacttctccctagctgagccagaaaatataccatgtgtgacaatagcgataacctccttagcaccgtgatccattaatgtgtcacaagctttcaccagcgtaccacacgtgtcagccatatcgtcaatcaacaagcatgacttaccagcaacatcaccgacaagcagcattcgcgaaacttcattagctttttgcctctccttatgaatcaaggcaaaattcatatccagcttgtccgctaaagaagccacccttttcgcaccaccagcatcaggcgataccagtatcgcattattgaaatctgttttggtccttatgtaattcaacacacttggttcaccgtataaattatcaaccgggatatgaaaaaacccttgaatttgtgaagcatggagatccatagtaataacatgatcacaacccgcagtttccaaaagattggcaatcagcttcgcagtgatgggcgcccgcgatttatccttcttatcttgtctagcataagggaaatttggtattactgccgtaattcttctgactgatgccgtcttacaagcgtgaattaagataagtaattccattaagaaatcgttgatttcatgttccccgtaaccagtttggatgatatatacgtcttcatcacgaatgctttcccctattgtaacagacgtctctttatttgaatactgatatacccccactttagataacggtacaccaagcctttgggaaataagctcagcaagcccaggatgtgagttaccggctaacaacttaatactgtttgtagacatattcaacgaaacttacgacaagatagtctttggatgatgaggaataacctcttcttagcaatccctcgatgcctcctcatatcatctattgttcaaaattttttcattgttgaaaaatagtcacgtgcttaaccattttgctgcgcgatttgataggaggataaatacacgggcataccgtatctgttcaatagcaacaatgtcggagagagctaaactagccaactcgctatcctattccactggtcgcttgagtcgatatccttccacagcaatattgcactttacaattaggatagcctccccaataaaataaggaaattttggttatttgtgttcagaaaaagccgaaatcgattgcagagaacagaaaggaactttccgattatcacactttaggagccgtgataaagaagactaccatcgcatatcgcagaaaagactttaaatattaactaaaaccgcattcgcaaattgcaaacaaagtacgtacaatagtaatggctacaaagcaggctcacaagagattgacgaaagagtacaagttgatggtggaaaaccctccaccatatattcttgctcgccccaacgaagataatattttagagtggcactatattatcacaggacctgcggatactccttacaagggcggtcaatatcacggtactttaactttcccgtctgattatccatacaaaccaccggctatcagaatgataacaccgaatggacgtttcaagcccaacacacgattatgcctttctatgagtgattaccaccctgatacttggaatcctggctggtctgtctcaaccattttgaacgggttactaagtttcatgaccagtgatgaagccacgacaggatcaattacaacatcagaccatcagaagaagacattagcaagaaattccataagttataacacttttcaaaatgttagattcaaactgatttttccggaagttgtacaggaaaatgtagagacattagaaaagagaaaattggatgagggggatgcggcaaatacaggtgatgaaacagaagacccttttacaaaggctgcgaaggaaaaagtcatctcgttggaggaaattctagaccctgaagacagaatacgcgctgaacaagcgttgagacaatcagaaaataattccaagaaagatggcaaagaacctaatggtagttcttcaatggtttatattggtatcgctatttttttgtttttggttggcctttttatgaaatgaagcaattaaatgaactaaactttagataaaattttgacaacacagaatagaaatcaatagtattatatagacaaaacggatctttttattatgaacattgtgaattattaattatatttttgagtatgtattgaccaagaaacctcaataaaaatgaggtgaaacctagggagacagaaactcccattttcaaaaaccttcaactttcattataagcttaccttgagcacgttgtgtagccatgtaggaaaatgcttccttgaaatttttccaggaataaaccttatcaacaacgcaatctacgactccctcatttagcagcttgccgcattcatgtatccaatcattcttcttggggataatcttgatattggggtcaaagtaaaaatgagaataatcgtatgaccataacattgatccaaacatttttcttgcattggcgctagggttatcccaagaatcaaagacgtctttcttataatttccaacataatcaccaactgttgtaatataagcacctttagcgtgaattaaagaactcgagtgactcaagatatcataaccaccgatgaagtccaacaccacattaaatttaccctgagtataatcttcggtttctttgagagtattaaaatcatcataatctacaactttaccggtatccaacatacgtctgagtggtttactagattttcccctacatgacagataatttatgaaaatgatttcatctttcaaatccgggaaatgttctgacaggactgctgcaccattacctgacgttaccactactagctttttagaaactttatagtaacgcttcaataactggatagcaaacatccctacagagcttgtaccaccgtttattaaaacattagattctgtattcaattgatccttctcctttagttgagctaacagattaagcgctgttcctaaacagaataaggagcctgctgccttttctggtgatagagtatttttgggtcgcattaaaataggatcgacacgcggatcaatgagcaacgaactttgcagggcgccaatggctaacttgggatgatagtaaatgccgtacacatcgtcacccacgttccatctatttgtcaaattatcaccgacatgtgttatcactccgctgtattctcttccaatgccggcttcaccataaataggcttggtgtaaccattcctaatcttcatatcaacagggttcaaacctacatagttcacttgaactaccagtttgtttttacttatgggcaacttaattttgttctcatatgaaaaagtaatgggaccgtgtttagaatgaaaaactaatgacttaacgggaatatgtcttacatgtcttaacggtctggcgactctagtcagcgtaggttcatccacggggattggcttcggcgctgaaacttcatggtccactgtcatcgcttctagtttagggtctttattttccaagattttctctgccatctttctatgctagtttaactttcttttgattgttacgtctttacttcctgcgtaatgtacccttcaacttaagtataatcgtgcatcccttcctttatacttctctttgtttatagctggggcgatgtctgaaaatcataaaataggatgaataatggcgatagagggttttacaatcaaggtcaactggacgcaagaaaaggctaagttaaggtaggtcttcgacttgacaacaaaacttcccccttaagagaaactgaacttgacctacagagaaattcgaatacggatattattggttctcccctcgttgtgagtaattccatttcaagcagtaaattcatggacttgtatcgccttgagcaatgtactcaataaaaagagttaggctgagtgaattcttaatgtacgtaatctatgcaccgcttaaaagtttacttgaagcctgtcgtttatctttagctaccgacttctgggcataataaccaaagtcatattttaccgtcattaaagtgaaagtttttactgcgaaacatcttgacatccaaataatttaaacccatacaatatttcaatatttttgtctattactgaaagttctcggagcacaatcggtcgacaattcgcccgaacagagattcagcctgataccgacttgcccagcccaagtgggcagagaggaaggagaaatttctcgggtagaggggagggacagtccgcctaacttccttacgaacgggcattgctttaggcaggaaagggtcctgcttcagcgtggacattgaaacttccattctgcgggacgagcttgctagcattccaatgcccatcgtattgtactcaatggtgaaacttattaccaccatattgttaaaagctattatttagcatttttacttaccaaacattgaaaggagactgaacacaccacgataaaacgtatgttctgatacccagcaaatgagaaagtagaaggagaaacctaaaaacctgtagcggtcaagactgctagcaagatggatatttagatcataaatttttacacatgcatactgagcaatgaaatcatgcaacctaacatttgaggttaatatatgagaattaactagcgttgaggaggttaaaagaccgaagaattatcgatgcaaggaaaaatgggcctaggatgaatacgagcaattgaaatacatttggaatactttgtgaaaatatcacatactctcgccttctatctcgatgcgttattacaagaaaatagttttactaacaaattaacaaaaattaaaatagtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataataagataatattttattacactacatgtacaattttacttttactttgtgttgtctctatctgctttcttatttttaatatttaccattccatttataatttgtaaaacaattaacataaaagtcttttaaactctagaccagcaacatatcttcaaatatcagttgataaggtaaagtatgttgatagcattctaccgtcacacttatctagcagatctttgttaggtagatctgctaatatattttacgtaagattcgttgtatgtgcgggaaaatttgtatttgttgtggtagtcactcaccctttctatgtattaaaaactgataccttccatactagaaaagacaatcagttgaatccttctccaaattaaggatactattgtcacttctccattgagattcgaaaaacccctcgggtcttgttagaactaaattatgttcataggggtgggatttatattgtaattccgcgaggtttacacaaaagatatctcaactctagccgcacatccattccggtatgtactctcccaccattgggtattatagaatgtaataggtttcaaagcggatatcttttgcccggtgagttgttactttttcattcgagcaatgaagtacattctagaagttcctagaaccttatggaagcaccaagaaaaaaggaagttaaacaaaacactgattcaataagcaaggggggaagctccttagtttgacgacagtaacaaaatgttcgtataaattgaacaaaactcaagccaataaaggacttttcaaaggcctatctcttctttctccacaactttcgaataaaaaccactaataaaaagtaaataacaaaaacaagaaaaaaaataaacaaaacaataatcatgtcaaaagctgttggtattgatttaggtacaacctattcatgtgttgctcattttgcaaacgatagggttgaaattatcgctaacgatcaaggtaatagaacgacgccttcttatgtggcttttactgacacagaaaggctaattggtgacgctgcgaagaatcaagctgcgatgaacccacataatacagtattcgatgctaagcgtctgatcggacgtaaattcgatgatccagaagtgacgaacgatgctaagcattacccattcaaagtgattgacaagggaggtaaaccggtagtgcaagtggaatataaaggcgagacaaagacatttactccagaagaaatttcctcaatgatcttgacaaagatgaaggagactgctgagaactttttaggaacagaagtgaaagatgctgtagtaacggttccagcctatttcaacgattcacaaaggcaagcaacaaaagatgccggtacaatcgcgggcttgaacgttcttcgtatcattaatgaacctacagctgccgctattgcgtatgggctggacaagaaatcgcagaaggagcacaacgtcttgatctttgatttaggtggtggtacttttgatgtctctctgctatccatagatgaaggtgtctttgaggttaaggctactgctggtgacactcacttgggtggtgaagatttcgatagtaggctggttaactttctagccgaggagttcaaaagaaaaaataaaaaggatctaacaactaaccaaaggtccctaaggaggttaaggaccgccgctgaaagggccaagagaactctgtcttcgtctgctcagacatctatagaaatagattcattatttgagggtatcgatttctatacttccattacaagggcaagatttgaagaattatgtgctgatttgtttagatctacattggagccagtggaaaaagttttggctgattcaaaattagataagtcacaaattgatgaaattgtacttgttggtggttcaacaagaattccaaaagtacaaaaactggtttctgattttttcaatggtaaagaaccaaaccgttcgattaaccctgatgaggccgtcgcttatggtgctgccgtacaggctgccatcttaacgggtgaccagtcgtcgacgacccaagatttactgttgctggatgttgcaccattatctctaggtattgaaactgcaggtggtattatgacaaagttgatcccaagaaattcgaccatcccaacaaaaaaatcggaagtgttttccacctacgctgacaaccaacctggtgtgttgatacaagtttttgagggtgaaaggacaaggacaaaagacaacaatctactgggtaaatttgagttgagcggtattccacccgctccaagaggcgtaccacaaattgaagttacatttgatatcgatgcaaatggtatcctgaacgtatctgccgttgaaaaaggtactggtaaatctaacaagattacaattactaacgataagggaagattatcgaaggaagatatcgataaaatggttgctgaggcagaaaagttcaaggccgaagatgaacaagaagctcaacgtgttcaagctaagaatcagctagaatcgtacgcgtttactttgaaaaattctgtgagcgaaaataacttcaaggagaaggtgggtgaagaggatgccaagaaattggaagccgccgcccaagatgctataaattggttagatgcttcgcaagcggcctccaccgaggaatacaaggaaaggcaaaaggaactagaaggtgttgcaaaccccattatgagtaaattttacggagctgcaggtggtgccccaggagcaggcccagttccgggcgctggagcaggccccactggagcaccagacaacggcccaacggttgaagaggttgattagataaattcaaagatgcgatgaagtagcagcatcgaatttcttagtttttcctcttaacaactttttataagtatatatataagatacacaatcagtaattagcaaatgactactatttgtacgttctcatcgtcataattgccagagtttaattaagtgcctcaaccgggatgcgatttcgcgttcatatacaaagccgaaatgacaataagaaagtcatcgccaaacaacacgactaattgaccattaaaaggaacaaaatacagtcaaagagtttagctcggaaatgtacagcaatcataatttaaattcggatgactgttgcttcgattggaatgaagagaaggccgcagaactacagcgtacaggtgtttcttttgaccggagtttaacacctcaatctttaagaacatctacacgtagactatcagaagagaacaaacaacaaagtggcactatgcacattgacacttccccttctgtggtttcagatataatatcaagtagacgagatcgttcacaggatttttttgggcctcattcttcatcccctattgccccttcagaacgacaacgagcggatcagagatcacggttggagtccatgagattaactagacgtcgagacaaaatgaccaaagtacgcggtggcctagaaaagatggaggaaatgatcatgcaaggtgaacaccttagagaaatgcaaaggctaaagcaggaagcacaaaagaacgctctaccctctgacatggctgaatatatggaatggcaaaacaacgaggatttggaagacgatgagttgcttgcctttattgaaaaacaggaaacttataaaaatgaattagaacactttttgaacaatgctaataaaaatgtttatgagaacaactcgtatccgaactctcatacgtgatggcatcattgctattacagaaatagccctagcctgtcatatttaactgagctgttgagtatgggcatctttccgcatgctctaactacggagctggctcttccccttctattaatccttctggcaggaagcgaaagcgactgatgtcgtttctacgtttctatgtatattctatcgcgtttaagtgtgtatattttgagctgctcaagtgaagggaacgtattcagaataactagattctctaccatacgatcaactaactgtttaccatatacagtctcagttcgctacggttagcgtaccgtaaaacagcagtctacattcactatataaaggatgacgtaagaatttgcctacatattaaagaaaacttcacaatcaaactgctaaaatatacaaataattccgttcatttcaggccatgatgacgatccttcacataatcttgaacgggatcggtattcggatcatatttctccaattttttgatttgttctggcgcaattgaaccgcgtaaatctgaatcactttggtaccaatctttgatcaaccataccatttctttttttgccaattcgacatttccttcagagttttctatgatacgacttagaatgtaatagagttttaaatgagaaactccggcaagcaagaacattgaacatacagatccatcagcagctgaacttttatcaatgaatgattctaatattttattcattaagaaatgtacagggaaaacaacgtccgtatcgtgtgttgttttaccaattcgaattagtgtgttggatatcgaggaaagaaaggattcttggcctacacttcccacgtcaggcgatggagcatttttcatgctatcgagcaatcgattccactctccttgaatgactttttcatctttgaattgagatactttgaaaattcttagttttatttcgtagtaatctaatgggtctgcacaatcattaaagagatctgataatgggagcacccttccatttagtttaagtgttagttgctttctataatcttcgtcaatccttgtttcattccttaccaaattaagtaggtcatcctgaatggaagctatgtcgaaaagttcgtggatgttctcagataactggaccagtgccggcttttggtcgaatgacgttgagctatcacaaagaccgtttgctcttgctaggcattcgattctttcacttaattttaagtcaaaatcagaactagctagagcatataaaacatcagctgcttcaagaaaatgttcttctttggataagtagaaccacaacagattactaatttctagagatttttctgctctttctttcaagtacggtaaaacaaattgagaatccaaacgtaataagtagtcttgtcttttatttgcgacaagccaatcataaaagcaataatggaagaaccggttattgctattcattatcactgagtaaactcttttcttcagtgacgaagctggtgaaaaaatagatatatttgcaattgaaggggattgttcgatagatgtatagtcatccacgcttttgacaatctcaaaaatcaaagtgtacacatttatgcgtttgtcataaaaaacttttcttggatcggcagtattacaacctctagacacatactcttgtgcttggtttcctttatcaattttatctgcaaatctaagtagaaattcaacagtcttaggctggtaattaagttttaccatgatatccaccacacgtctcaattcacataattctatattctcggcacacctttcataaaggtcaattgcggtatctaaatggttccttgatattttagaatctatcatttcaaacttctgtgctgcttctaaatgctctcctgccctgtaacacaaaatgtctgcactatgacaaaaagatccaaagcgttcctttaaaacgttcacaatataatctgccgatgtgccgcttgcaatattagcgtttacaacttctattaaaatctcttttattaattgtttagtttttgcgttaggggtaaacaaatcatggaactgaagatcaaaaaaatactcacgtgtcttggagtcataaactccccctgcacccatcaatgtatttagcaaagatttgaaagcatcaatatcttcgtagaagacatttataagggaaagtgcatccttaatagaatttattaagaggataagagcattcatagcaatagactcagcatcggatgcagttatagcattgctacctttcggaggcacaaatgaaacgaaggaaggacggtggatgttgaagaaatctgccaaaacagatatcgatgataaataatactcaacctgtggcctagttatagaaataccaaaagcatccattttttccgttttggaagcccttttaaaaacaaagaccctctcttcccatatttggctaaataatcttgtaattaataacgcagaaccataaaacctgggagatagtactataccatcacattcaccagatttatcgaataaattttgtgagattggcggcacgctgccactttctctagaacttttcggttttatttcaactaccccaggtataccggcagagaagaaggccagggcacttgatttaatatgctctgacttattaaacttacaagctaaataaagtgccgtagagcaagcctcagataaaccataactgtgaataaatggcaaaggattttcaatcaagctttcgaacacttcgtcaggcgtgcgatagcaataaatttctaaggcattgcttgttaaaacggcaacttttaatggttctgcactgtattgtgaggcaaacacattagcgtaaccttggggtgtagaagtgtaattaaaggatcttgttaagggaacaatctctttaatctcatctgtcgtatcgagtagtgcggtattttctacatatttaccataattttttaatataccgtaatctggagcactaacgtaaagtttgtgttcctcttcattttccagcaaagcttgatttgtaatacctttagatggttctccagaattagttcttttcctcacgcacgtaaagtatatacctggtgatattatcgtactagcgcaagtggtattgatataagttgaactagctttttgtgttgaaagtgggcttgtatcatgtgtgtttgaggggtggtgaccgattatggaagatttattttgctcgagggagctagatatactggtaggaggaaactttacagagtctaattttaatgagccaatcgatctcctagaaatggaacctttgaaatataagcgcactccagtagtagttataacaactaagaataaatcattgttctcacacatagagatagaaacaattttggcaatcttgaaagctcgattactgagtagaggtgaattttttacacccaatgcatttattccacgcctgatgtgagcagcatcaatgaggaccggtccttctagcccgttgctagtaatcaggtaagatctgacaatagatttcgtcgatagagtatgtaaaacgcctcttgactggtcaacttcgagctgtgatatagtttcttcttcggtacctgcatccccttctagtactttttgtatcaactttcctccgggtatgctaggtattagttttataggtagtaaatttgctaagtttgactttgtcaaacatattttgttactcttgctattgaataggttctccgagcagttatattgtaattcccacacgttgacaccatcagtcgcaccagtgaaaaatatttgtccagttctttcatagcttattatgttagaaacgttgaacccagttacatttacttttaatcctgtgttaaagatattcaactcgtgagtacggtcatcaaatgatattgtcaaaatatagatatcaaaaagagtggcgacaatcaataaattttcaacagaagaaacaaaagtgtttgggctaggcttaactaatttcacttttaaaatggtgtgctcgatttcatcgatacagtggtattctgaactattattgatattccacaagatcaatttattatcagaggttatccaacaatagttcagttcgagaaaaatacccatatcactctttatttcggtatttgaaacttgtgataaaacttcatctggtatatttgtcacttgttgtctttggaagggggtaaatgcacctaatccaccgacttcatctgagaaattataatccaaacctttactataatagtctggattatctagtattggcgtatttctgtccctaaagctcaaatcctggacaaattcactagccaactgcaacggttcagaggaagtcaacccgcttatcttgacgtgtgtagttacgtcacgaagttctgattcaatagtatttccaacctcgccaaacttgtttaatacatcttttctggttgttttttcgcttaggaaggaacggctcgacaggttgggcttaccgttgttttggtcatctcttggccgattccttaagcgatttcctcctaaggaagccgaagccgtaaacgtttcgcgatcgtaatcaaccctcttttttagtggagttgaatacatcacaattgaaatccgagctgtagtttttgtgaaatgtttctcctacaaacagattttattcttaatttctttctattgatttataaagccattcaaaattcagatggaaattattcattagaaatctttcctctccaaagtcgggtaatactttctattttgtgtcactaattttataatactttaatcagcaaatactataataatagaataatctccagacgttcatggaaagatcaacaatggaaacgtaggccatatttatttactagcaaaagcattttcagagaatttttttgtttcctgaaaaaaaatgagggaaaaaagaacaatttcaaataaagacacaaactatctcaaattcccaaataaactccaaagatattcccaattcttgagcaggaagatatccaataccagcccagaaaagcaaccgaagaagaacataaaagaacactgtttatcgagttatcacaaagaacactcggtaaaaccaaagcaaaactccggtaatgttgcagcaaaagaagacaaagatacgcagcatttacaaaataatgtcgctaatgaagaagcaacggaatgtctaacaagaagtaatttgaaaaagttacaagagaaaattttcgatagagaacttaatgatattgcctgtgatcattgtctttgtagcacagaaaatagaagagatatcaagtattcacgactttggttcctttttgagttggaaatgagtgaaaactggaatgaaaatctccgccttagttgctataataaatatgtgtattccgcaattgatgagtcgtggataatggagaatattttacttaaagaacaagagaagcattatgaatattttccaataggacaattactgatacccaataatattgactacactaataaacagaaaaggaaggaaaacattgaagacttaacaattgaaattgatagtattatagagacaaaccatcaaaagaaaagatttttgccgcaaagtgtcctgataaaaagggaggatgaaattgcatttgacgactttcatttggatgcacgaaaggttctaaacgatttgagcgccacttctgaaaatccattcagctcttcaccaaatacaaaaaaaattaaatcaaagggaaaacccttggaagtggttcccaaaaagaaaaacaaaaagatcataggtgctttggaaagaaagctacatatagatgaaaatcaatgaaagtattgtctgcacattaccaccggttaaaacggcgactcagtgtaacctgtaaaactttttatcaattttgaataggtatagagagattttcctattctctccaaaagaacctgtatcattaaaaaatatatatcttttacatattgcaaatataaaaaaatataaaagtaatgtgcttgcgcacggaagctatccgaagaacgaatttcaccttttctttttctctttaacctcttcatcagttgtggcatgtagcctaatgacgtttggatagtcgggtctgttgcccatatggccttgatgccaatcataacttagagcgtacgcaaatacgctaccattcctattgaagctgcatacaggaatagatgcttgcaaagtaggatagcctttcaatctatgcctttgattcttatcccaaaaattgaaggtaccatcaccaccagccgtaacaaaagtaccatataatggatgaaatgcaatgctatttacagggtacactagagattgaccattggagccaggtgccctattaggattggtttgacgatggcatttaaatgaaaagcctgattttttctgcataccatcatcgatataccttatggagcatctaccttctactgaaccaatcgcatatccatcggcttcattataacatgccacgcatcgagtttgccattttaaaggtgacgtggttgccttaaaaatcgttgttgggtttgctagattgataatagcgatatgtctttcggcagtagccactactaacagagactgtttattatccatcgaatatactctttcaggcatcattacggtggatactggctggggttgtctcatatcccaatattttatggttttatcccaggatccggttactatacactctgtgttcgatggtccacattgtacaaaacgtaatacttttattggcgcagaatgcattccaatttgctgtgtttgaccactggcaatatcgtacaatttcagggcattatcacacccgcctgaggctacttttgtaccatcattcgaccatctggtacataatacagggctggagctttcatgctgcgctctaccttgaggtacaccattttggacatcccaaatacgtaccttaccgtcccaggaactggtactaaacatgaaatcttgttgcggtgaaaacgcaatatccgatattgagtcctctgctgggctattaatgacaatatcattggccaaatccttttcattcgccattgcagtactcgttcccaaagccgaggttgtatttgatcgattaaaaaaagacatagttcctcacttttcctcttcttacgtatttctttattttattgtaatatgcagattaaggtttatgatatttgatcaaggtggatgtgccggaatgattggtatggtaagtttgcccaattcttataagtctgtctctgttcaagtaaaatggttatatagtgcttaaccggaacaaacctttagcaattgcgatcaactaagatatcttattgtaaaccctaccgtcatcatatgaaatatcaatcttagaaatcttagagagcaatacaaaaaaaaaagagacgagacggtcatcgtaaatcatgatcatagtaatgtcaaaagttaatttaccattatgtcaagctacttcaatgagtgtacagcaaccagaaaagtgcctgtatttaatggttcaaatgttctttttataagtacaatattttatctaaaaattaaacacttctatcttatcatggaagaaaaaaaaagctatcacaaaacaaatatcctaaaaaaccgtttataaaaagtcgttgctgtgaaaatggttcagttcacagggcttaaacccatccccaaatttagcggaatgtcagatacctaactccattctcctagctttttattatgtttcctgtcattaagagtttttattttttattataatactcaacacgtgacttcagccttcccaattaataaaattgaaatcattttcatttgtatccagtaaattgagatcgtaatccggtccttggtcttcaaccataccaatattcccaaacttcaagttctgagagtgtacattctgattttcattagtactggtttgctgaggacccaaagttgtacccacattggatgagggctgaattaatgtgttatcattatcgccattatttgtagatgcagaggtttcatcagcaacattcgaattctcgtttggtgttctattgttagaagcataagcttgattaggaaacaacaaagaacttgaatttttgagggcgtcaaagtcatatccttgattattactactcggctttttttcctctggagtagataatgtgtcacgattgcctttactacttcttgagtcattgcctacttgcgcctccagtatgtttcccccattcggcaattcttggaatgctgtattattctgtgaagtgattattttagagctctttaaagtaatattcaaattggtggttgaaaacccatgtggcggctttataaccacgtttcctggtacattagaacttctttgctcctgagcgtcaccagacggaggtgttgctatgcttaatggggatgatgccgaaacttttgagtttactgctcgcttgggtccatttttcccggcaatcttgccactttctggatcgaagcaactctctgtcaccgaagataatggactggatacagccggcttgttgaaacttcccaaatttatacctggaaaaggtagagaattcgcagttttagtgggcggagcggaatgaatattcggagcagtagtattcgagaatgttcttaacatattattctcatccttagtggcatcagcattcagaataacagaaggagtggatttcctcctcaacactctagtgttagggggactgcgctttttacctgtcaccacgctgttgccaccgagtttattcgcagactctactggaaaagctgaggtggatgccttttttgtatttttccttacctttgtgggctgtttagaaactaaagcggaaggtgatgctccatccaacgacgggctagatttggaattagaataaatatcttcctcgccaaatattattgcttgattgcggaagttagtagcaatatctgatcttggagtcttatttactcttgaacctaccatagcgggttcacttgttgttgagcctggtgtggtaatatttggcgaaccagcgttcgtcgatcccgcggaaactgtagcggtattattttttcttcgtctcttagccactagaccggctttaactttacccttcgcttttgaggttgcagatctacttcttgtagattttgacgtcgggacattatttggtttatctgttgaatgcatagtttttaaacttttaggttggttcactggagatttgttattagttgtattatttgtggtattattgttacacgggtttcccactggattttccgtagtgggttgcattggataattatagactggccagccagtaacgttttgactccgattctgggttggccctacatttgcaaaatcgccggaaggcggcgctgtgggagcaacagcagttgcaccagtcgtggggtttgcattattgtatggtggaatggaaaagttattaacgatagggttaccaaccataggaattggtatagggttcatattaacattgcgcatttgaaccgcaggtgccataggatttcctagcatcatagcagccaagtgcatggggtctatgtcctcgttactatattcccctcttcgttctgcatcgtgttgtagccttgccgcatgagcagccaagcttctatatatttgttcctgcctttgctcttgaagaactagttgataatattgctgagcgaactctgagccacctctggaagaactggtattaaagatgtcccagaatatttgccaccattcatacaaaaagccttgaggtgtatctactaccttcgagaacgtattctggttaccattgttttctttagatttgggtccgtcgattgggttttggcctttgtctctatctaggtgcgcatcttgagcaaaggctgctgcagtgtttttcaaagacgacttcgtaagaaagtcaaatatgtactcattgagcgtattcttgcagttcattttttccttcaaatccgaattttccgccgtaggttgatttatccactgctgttgttgtcgctgctgttcactattcgttgccattgcaatattactctgcaaatcttgtttatactggcttgccatgtacggttgttccgtgggaggaattgaatctggatacgaactattcactttataactcattctaccacggaatgcgtttcctctttatttatgtctataaacgtcttcgtgtttattttttatagcctcagtgacttactaacgtcaactcaccgtgtcttcggcaaacaaaatggtatcaaagcaaatgcgcttgaacaggagtaaaaaatggtcactttttcaatctgtattctatgaattttatcagtaccggtctcaaaccaaccctctacaacttcatcgtgatcccattctttcttcgttgtcttcccacgctcttccggaccctcgtaaaagagtccgaagccgagaaggcgcgatttcatgcactatacactcgttggcaaacacaacaatggaccctggccagttgaactgtggtccctgttgcgtccactattggtatgcatgcatgtggacgcaagcacacgcctgcatacacgtttaatccctcagtatcccactcccagggctacttattcgaggcattttctatttttgttactactagagccagcattagaactggaaatacagcaaaaattttttcacattcttatcacaagaatgcgcaggagaaggtaaaacctgcaggtaacttgcatatatttcagtaaattacatgtactatacatcgtcaaataatttacatttgtacaagaccaatatccgaggcccgctaattagtaacgtgccgtgattctttcattagaacaagtacaagatgacctgaacttgcgcgtattcatatggaaaatacgcaagacccggttatttccgttctgggatattcgccggcagctgccttctgttcgaattgcgtcgtcaacatccttttgagctttctttaagttctttccttcgagatggacgatgccaagagaatcatcgctgagttgatcggcggcgtgtagatgcgccgatcaactttacaggacgaaactcacataaccttaatacaataaaaaagtattgcatacaataggtccttcaggacacatacatacaagattggcaaaagtgaaggcaggtgcctaagattgggtgggaaagtaaatttacatatagttttttctaggaaaaaaataaaaataatgaaggaaggtatacttatataagcgctgtttatcgaaacagacgagaataaaaaatggttttaaaaaaatcaagcaatgacggcagctaaaaccggattttgagcaacaattccgttgtaagtagtgtttagatacttcaataattcaataaccttatgcttcatctcttcggtttggaattgctttaatctttccatattctcttccctacctagagtagactccttttctaacttaattctatcattttctttggtaaacacagcactgaaaatctcgatgatccttggggtttcgtttgtgataacgggactattttcctggtatagtttcatgatcaattcgaaaactggattgtattcttcaaaaccggtgtttagtggtaaatgtgccaataatgctggaacagtttgttccaatggaactagagcactgttcttcaaagccattctggccacacatccactagcattagcgtatgctctatcaataatctctctggtggcttcgtcatcttcggctgctaaggccttttggtcagcagcacttagtaactcataaagcgccttcaaaacaggttcataaacggctgagatgtccatagaagcatattcacacaacaaaccaacaccataagcagcgttacctctaacttctaaagatttatcgcttgttaatctaatgactaaggcttctagcatttcatgaacgaaaggattttgttctttcatacctagagctaattcagaggcggcaccgacggcggatgatctcttattcttggatttagattggaataatccgaaaacaaccggtctgaagttgtcaaagactttggcaaaatcaccagctaaagcttgagataaactgacaagaacttccaatgcaacatcttgtaaagttgcttcggtttcagaagcgtctaattcttcatctcttggaacgtcctcctcgatatcaatggtttgacaagtatgggtacccttcaagacactaagaacttgcatgcacaaagcttctagcatagaagagtcgccgttgtccatgatgatgattgcgccaaattgcttaatcatattggcaaaatcttccataacggtaatgaccattgaggtttcgaattcatcgcttaagttacccatggaagtttccctggcagcttgaataaccgccaaaacatcagcattaacgtaggaagaagctgggatacccttaggatagctttctggttctactttggaagccaaaaggacagacttaacaacattccagatggtgtttagagcagtttctcttaaaccgtacgactcatcgacttgttcattcaaaacctttaaggattgttcgacgtatggcaagaaatgctcctttgtacccaatgctaattcggatagagctgcagaagcaacttccttttcataggaaataccagtgttaacggtgaatttgttctgtagttcttcttcattggcagaatcagcaaatgcggctaaatcctctgcatcaccatcgaagttgaattggtattcatctaattctagtgtcttgaagatttctggtaggatagttttcaagaaaggagcaaaattttcgccgtaaactttagccaagtttgcaatgaatgcataaccagattctcttaatctagcagaatcagttttgatggcctcataggcggagttaaccaaaggttcggcaaattcggcaaatgcgtctgatctgacggctctggccatagtagaaatattttcaaaagtgttggcccttagttctatatcatcttcgctcataccttcaatttgagaacaattttggatgaatttttccaaatagtgaacactagtcttgaaatatggaatgaacgcggaacctgctgcaaaagcagcggaaccaattgcagaaacaacagcacatctcaacttggatgattcattactttccaacatatagaatagtttgttcattaatggatccaagtacttagcgatagcatcataagcaatgaactcaagcagaccatctaaagcaacagttgcatagttgtaaatgacaatgtttttcgcagaatcaatgatatcgatgatcaatggcaagtattcttcatgaaatttggcaacttcgtcttgtaagtcagtggttaattggtgaatacacttcagagcagctaatttaacaatcggttcagtatccttcaaaccgtttatggtggcagggataattttgtcgaattgagacaaaatgtagtctggagaaccagtaacagcaacggaaatagctaaaagaatagctcttctctcaaaaacgtttgcggattgcaacatagctggaatgtgttcaacaataacggaagcaacctgggatggtggcagttcagaggaagcgaaagctaacagtctaatagcagaagaagagggtgtattttcctcattttcgcctgtttcgtcttcgttgtttaattcatcgtcaacatcgatctcttcacaagccaccttcaaagctgcaacaataatttctgggcccaatttgctttgagaaaccttcgattttctgtaggacaatgaagatatgatgaattgaagagcaaaaactcgaacatcttcgtcaatctcactgttaacagcaatttgtaaagacagcttaatcaaatccacaataaagtttcctgctaattgggagtccaatagcaggaaatcgtttaaacagttaaagattaatttagcgttcatggtgtcgtcggccttgataactgcgtctaaaacgttaaccacagatggaattgaggcggcgaatttttgagcttgaacagggttgatggtttcttgttcttcaatcaaagcagaaacgtggttcaaagcctgggcagataatgatctgatctccagagaagatggatcattaattgtctgagagaacaaagccaaaaagtcatcgatgtggccagatagagaagaggtgaaatcttccaacagagaaaacaaaataaaaatggcagtttgtcttgtttgaacgtcttcaccagaagcagcttggattaggttagggactaaatctggccatttgttaccatctagctcttcagtaccaatagaagcaattactcgagcgttggaatgacgaacattttcttttggctcactaaatgctgtttgtaaaagagaggttttgatggaggctctagtggattcatcaatggcgttccagtgcttggaaaccaactttctagcttcaacaccagctagttgtttcaacgaatcatcggagccgttctgcaaaatatgaatcaaagctggcaaagttgtaggctgggtataaaattgagtttgcaaagtttttgtagcctccttcaagcctacaccagaagtgatagcgtgcaaagtttgctcaagttgacttagaaattgttgatccattatactacttgatactaaaaaagtgtttttcgtccctcagtttttatgctgctaaggcaggattttggtaatatacagaaacgagaagaaggatccttgcggggtcttgcctattcttttttgttgactaataaaatcaataccaaacctgacaacaaataaaatgaaggatctatggataagtggatgtttctttattttttttttttttttcttcaacctcatctcatcgcgctttccattcatcatattgtacgaaaataaagcacaatcgtaataaaagacatcctgataattagcaaagggctaaccataatagtctaagtttagtagttcaaatgtttgttgacatgcacttgaagtaactcaagcgcaatgagaaaagtgactatacaatatgtaaaaaactgctaccaaaaaaaaaaaaaatttaaaaactctgataatatagtaaaaattattggtacattgtgaattaaaatttatgcgtttgccctcaaatccttttctatatcgtccaattttgagtcaatgttctcaattgtgataccaatcaagtttctgtatttatctaacttcaccgatgaattaattttgcttttagcttcgcttattttcaatgttgtcatccttcttttaaactgtagaattgttagttccgttgctagtctcaacgtctcatttacatcatatgattcttgtacagtattagaaaatttggcgtccgctttggtgtttttaggagaagaagtttccgacgttgactttggaattggctcttcatcttcctgtttttctggatgtgaacttgagttagtattcatatcaacctttgattcctcatcctggacaattgtagccagttttaaagcttgagatttttccaagctttgaataaaattttgcttttcagaattcaactttgacgatgtttctttaatccttgattgtaaatctgatatcgaatttatgggagttttgtttgatacggaatcgaaagcatcctctatttgatgtgctattgtaatcaatctcttcttattgttagaaatagaggattcggtttctactacttcgttgtccagatttttaatttcttcacccattattctttgtagagaagaaacttttgtatttaatttgttgatctgctgcgaaagcggttttgagtactttcctagtggagacatctgtatcggcagaagggaagaaggcgattccaatgatggcatggcagttttcacactattcaagggatcctttttcttttcaacttgattttcattatcctttgccttttctttttcatctgatattgactgtgatcttcttctgtataaaatgggagagttttcaagaattttggatggcgtagactttatatctttaatgacagacgacgtcacgaaagaattaatattcgacaagtcgtccataatagtgttcatatttgtagaatttggctggttggaatgcaggtattgactttcgttgacttcagaatctgttttagctatattgacatctgcagtagaatcttctttatcaggatgttgagtttttataatttttggaattttgacattgttttgtggttgctgttgctgttgctgttgttggtaataattcttttgaggaaggtttcgagctaactttcgatccgccttggtgttgttgtttctgctgtttgacccgccagccggagtattaaacttattcattattgacgcaggcgattcgttatctagattcaatatatctgttgacgcaccaagatataccagtctgttataaacctcgaagttcaagtttaaagcagataaatgcagtggagtgttccctatattatcttggtagttcaaacatatcttcagcaaattgtagtcctgctgacccaagctcaatattatcgaatccatataggattttattatcattggatttttggacttattaacgctcaattcaattaaataatgaaatggcaatcttccatttacgtcgggagttataagacatatttttaagatggatattatttcatcaaaagcattctccttgtagcaattgttgtagaaaattgattttgtgatgcaattaaaaccgagcttattacactgtaatgcattagcatttaaggtaattagcatttttatcaaaggaatattcgccatagctgtagcccaatggagtggagtgtgaccttgatcatcaatttcaaaatttatgttaaaatttttgggcgccggatataaagtagccaacaacgcttgatctacatcagaagacctttccgatgaaagtattgttaatatcgtctgcttgtattcttgatctgtcattttgttttccaacttgttttgagatgaagtatttcctgcgctaaacggtgtcatagatcgtgaagacatattcatactgttatcattttcatttgatgaaaatacttcaatggaggagccattggatgctacagtgttgttgttattgttgctgccgttactgtcacagtactcattatggtgatcatttggattttgaaaggattgccataataagggttgcttcattaatttgaaatgcctttgtattttttcttgctggttgtaaaattgttgttcattagattgattcagctttttcctcctttttttactattgccatttgtaatggagtccatcatggaatgattgaagttattcgtcaaatattcatgatgatgatgttgttgttgttgttggctttgcataagtccgtctggaactatgatcaagttattattattgccattattattgttattactgctgttaatgacattgtcgatgttatggctgtaactattactgtcattattattagggttattcagagcaacgttcttgttttgtaaatttgtcggaattggaaaaaattgaagaggtttctgagttgccgaataattattattgaaagagttttcatgaatggatttctgttgttgaataatagtagattgattgctgttgttactaatattatttattaaattgtgtcttgtgtcattgttgaaattcatcgtggtgtggttatcattattgttcattatattcattgatgaatttacttggaactgttgaggagtttggaaaacaaggttttgtaaaggacttggattcggctggttgatcgatgcatttttcttgcctttcttattcgcagctgtagttgtagctgatgttgttgaactactgttcttttttcttggcgttttattgtagctcgatggagaagttatcttcgttcccggcgaagtcttcctcaatatactatttttgcttctctttggtggagggttatttggatcgaattgaaaagttaagatggagttgaccacagggtcaattatttcgtacttattgactaaaaacttcgctgaatccagtgggatccaagtaccttgaaacctaccatacccaccttgaactttttcatgttgcatatcatttgattccttttccagtattttagttcttttcgtcttcgaaaattgagctattttgaaaacctgggtaatattaatccaatcatctttagttcttctcatcactattttagtttcaaacccacgtatatagcattcgtatacatcggtttctgaatacgtagctatttcaatcactggatggtttgaatgaggcgccaaaagaactgattttgatattggcgtgatgttctggtgattggtattatctttttgatttgatatcaaaacatcaaatggcatgatttctcgaataaatcaaccttttagaactacgcaagagggacagaagggaaatgagaaagaaagaagagttaatttttggcaaagagcaattattgttgacaatatatcaaataacgtgaaataatgtacctttttttcaaagggtaagtggaggaagaatcgtttgaaaaagcgacgaccaatgctagatgtgattctgctgtaacaacaattaatagtaaaaataacacaatacactaaagagtttctttttttattatctcgaaaaaaaaaaaagcttccagttgaatttagcagcaaatattagtcaattagttgatatgctaaaccaatgctaaaggatggcaatagctataatatcttttgtgcgtttttcacgttgacgtgcttcttagtccttgttcctcttttttttttgttaggttaaccatttatttcctaaacgggaaataagcaggcggggagctgaatataataactttcgcgtcatggttagtgacgcgtcacttcaaacgcgggtaacaaaaccaagttgtttttagccgccgaaggtaattgtatccataatgaaggctagattagaccaataatttgtagtgacaaaacttatagtcagtagcagattctttttaaattgagagatttcgatagccttttactagatgtctagtttagtaaaactaattttcgtatgctgctaaacgacccaagatccgcagtcacctatcgtttaaagtacgcaatcacaatgcggttgaaatgtaatgtacttatattacctccttcttaggtaacatttcattttttccgctaccgtacacagagtaattgctttgttcgttatctacttgtactgaagtccctctaaacctactgccttttatttttaggccctaaaataaccatggacaacgtgaattgggtagcatcttttttttaataggtagtttattatgtataacaataatttaaagatattcatagtgataagtaattttaaatgtgtttaaagtactacttttcctttaccgccagtttcctgtactatgaaaaaggcaaattccgcattgtagccgcccacacgtattttgatcatcaattacgaaatttgccgcacacgtgtcacgtgataagcactcttactatcatgttttacggagtagcaatgatggtcgattattgcagctttctttcgtgaaatcgtaatatcatagaccttcctaatgatggaagcggtaaagaaggaaatcgtaaaagtaaattaacgaagtagtattagtaaaacagagttgaaaaactgataaatcctcaactcgaactgaaaagaaacataatagaatattttttctcaatgctacctttatatcttttaacaaatgcgaagggacaacaaatgcaaatagaattgaaaaacggtgaaattatacaagggatattgaccaacgtagataactggatgaaccttactttatctaatgtaaccgaatatagtgaagaaagcgcaattaattcagaagacaatgctgagagcagtaaagccgtaaaattgaacgaaatttatattagagggacttttatcaagtttatcaaattgcaagataatataattgacaaggtcaagcagcaaattaactccaacaataactctaatagtaacggccctgggcataaaagatactacaacaatagggattcaaacaacaatagaggtaactacaacagaagaaataataataacggcaacagcaaccgccgtccatactctcaaaaccgtcaatacaacaacagcaacagcagtaacattaacaacagtaacaacagtatcaatagcaacaaccaaaatatgaacaatggtttaggtgggtccgtccaacatcattttaacagctcttctccacaaaaggtcgaattttaaacaaattttgtattataataattatgtacatatataaatatattggtacatatgtactgtgtgtgtatgtgaatgttgattaccgttttctttaaaaaaagcttttcttctttttattaccgagctttcctttggtttacaggttgactttctggtggtatattttatttataaaccatgaagccgttaagtaacttaatgcgccaagccctaaaccgcacattacgttgaagattaaactataacaaatggaaattaagatagatgaaaacccatggatgtttagcactgcgaaaatgtaatatagcgaatacaattccatatatacaccaccgctaaatcccatttcaaagcacttccatctccaattgttgcgaaccaccttatcttcgaagcaaaatctcattaataaataacttccaataattgatatctccatagttaacacgcataatagtatgatactcaaaaaaaggaatccgtaaaaataataaaatgtagttttctccaaccagagagatttgtaaacgtattgcatttccacgtaaattactaacaaggggaaaataccacataaataaatgccgcagtaaaccaacgggttgaacttggctcgtgatttaggtacaaataatccattgccatcgctattgctttcatctttagtaattccactcaaccaatattgaggcaaaggtatattattagctacaataccaccaaacaagctgagtggtatacagacaatgaaataaatgctgatgaaaaacacaatagtcttgaatggtaatgcacttgtagaatcatgtgcccaaacaatactatttaataaaaatgtgctcaccattactatgccaggtaagctggacccacaaagtatcgtaaaaatgggactaaacttcttgtagtctttgaggtatctgttatcgtcaaggtaattggccttggttcttttcgttttcgttaccatactgagtcttgtccctacgaatgatgccatgaatgctccaagtacgaaaaataaaatggccatagttagcacactgtttcttacattatgcaatttgttcattgaacatgatatcgttaaggatccaattatggtaaataaaaattgcaccccaaatgagaccagaaggattaaaacttttaaaccaaataaatttggtctaccattttgtatccaatctttcgccaccgtgtaaacggagtatttaccatacttgtcatcgtccaggtcatcctctgtttcaattccttctatatttatcatgtatttgggggactttgaattacttttatccgtgtacatgactcgtacgtaaataataagcgtgataaatgagatggacaatacaattcccactgaattggctaagctcatccaatgaaactgaatgctctgttcgtcagataactcacctgcgttcaagaaataatcccatctatgattccagtctacttcaaattcttccctccaatatacggagtaagtaaatggcaaatatgtcaactcattttcatcctcaggaatgactatttcgtattgttcgtagttcttcgatgccccaggacaatgataatctgacacagatcttggatatacttcaaagccgactatggtatttttatcattatcactggcatgaaaacgtattaccagcattacgtgattatgcagataggttttatctgtatcaggatctatgaaacctaaaggaaacccagatgcatagtattttttatgatcagtggtggaaataaacgtagtggcagccggtaattcatcatcaattagccattgtacgacgtatccctccctgactaacttgtctaaggtctgcatgccctctttggtagttttccgggcacacaacgtttcgcatggattgtcttcgccaaatttgagtttatagtcgctttcccatttcctatcccctcttattatttcgtttagagataaatgaagcggttttttatgcatagtaggaggacaagtgaagggcaagtcataatatgcgtatggtaattgcgttaagtcagattctaccttattcacaatcaattccaagggatcaccctttctatagaaattgggtgttatccatccgtcataaagattcttttggctggaggagatgactggttcctgcccatgccctcgcgttcgtgatgagtagaactggtttctgaagatgagcatcacgactactatcgccatgagtgttatgaccgacctctttggtcttactctcattttttctcttttcggttcacgtctttatattagtgcttcaatacctgatgcaagaaattcaaacggagaggaagcagtctagtgaagaaaaagcgtagatatactactatgcaattttgaaaaataatacgttgctttgttcatcgaagcaaacgaacgaggtgctttggaatgtagatcttagagtggaaaaaagtaaaacaaaaaaaaaaaattgaaatatattttccattttcgcgaatgcgatttcgacaaattagagacctcttagaagggtcctaaaattttaatagccttgaaacagaagtcactaaacagattaacggcatcttttgtttagctttcttgtaaattatatatggttacaaaccccaatccctaatctcacgcaagtaaaactatatagaataacatttaaaggatcatcggcatcctttcattttcaaataactccattcttttttgcccatgagaacaatagcttaatgagtttatgcatcaaatttgaggcgcatatttttcaatagctttaaaattatattttgtcggttttatgttttgaattatccccgaagtaatcctcttccgttgagaatttaccctttttctctgctccacgcatactactattgcgagccactccaggcgataacaatccggaagctagtaagaacggactggaaaatccatttgagccaatggttgtattgttagcagaggacaaattcggagtagatatagtattatcctcgtcggaagttcgttgggttgacgctgatattgtgcgatcagcttgaccttgattattgtcatgttgctgctgttgaagctgctgttgatcccataaaaactggtcctcatcttcctcattctctagcatttgctgttcccttagcttggtctcttctctcgcttctgctaacatctcttgcgctttgctcaaggaaaccgtaggtgttgtataggaactgataattggcactgatgtgtcgatatcaatggtggttttaattagtgcagccatccaacctctcatctcttctttgttatctactgcaaaatagtgcgtgcgaggttgtgtaaatgtcaaacctttctttgatcctggttgcggaggtaatagtttgaaacaataccgtcctttacctgtactggctgcatataatgaaactagtttatcatcttccttagcaggcacaacgcgatgagcagtaatgtcgataagacctctttctcttgtgtccgtagtggagctgaagtatgacaatctagtaccatgcaatgtgaaaaatctcgtcttccaagtactcatggcaccgctgcctttcttgctcatccaaccagaaaagtcagcatccttcattgcctctttaacactaatactccttaaaccttctataaatgcagaagtttgctttttcttggctacaggtctagcggtcatttgacgcaagcttttgcccttgagcgtttcacctttaatagcctcactcgcagacctcttatttttatcatctttcacagtttcggtaaaaatttcagcttcctttgcgctaactgatcttcttttagatctactctttttggaagactttttatcaactatcggtgagctgtttttttctgacggcattgaggttatgggattctcttcaggacttgaagagcgagcagcattatcagtaaattgttgcctaaagggacttagcatgaaggaactttttttgaatgaactagttcgcgatgcactgctgcttctctttaaagacgagttcctcctggaatcgctttttgatttagaagataatgaagacgagtgtctcgttggttttttcttcccctccttctcatgtgccaatctgtcattacttatggatgcaatggtagatccatcagcgtatatactggacgtgggtctttcgaatgtgttcattgtttcttgaaactgctcttcctcatggctggaacaagaggattttctatccgaagaagattcaggagcgtatccataataagggacagaattcctcttcgaggacgatgttagcttgccttcattatcttcatttctaacagaattacgggtgggggatggaataggtgacaacgccttcccaccgccttggttgttctttgggagtgcggaacgggaattgaaattagaatctgatgaagaatattgatcgatataagaagtccttttaggccctgagaaagataaagtaggtgattgccatgaataaagttgagtaggagaaggtgacgtccttgggttattcaataggggcgattttggaggttgtgctggactagggtaagatgggggtttgggggctctcctcggagaaacaaacaaattttcattacctgccatttcctctaccacctgaggaatttgaacatctggagctatattagcattagcctcttgtgaatcaaaaactaaagatttaggccggtgcttggaagctgaggagttcctagtatttctgggagtggggataaaattctgttgtgacggaaggtcctctaacgactgtgaagtctttctaacatggcctctgtaggaagctctctggtcaacgtttgcgggaggcatcaattggttataaatgttagcgttattggtcttactagctctattcagggagcggccattagttctaatagcctctttgattttttctatttctttgaaaatctcaaatcttgtcccaaaagaatttatgtccaactcttttaaatgaacaagctctaactctaacaaaattttacccgatattttgtgcttctggaatctagaggcagattgaacatcgtatccttccataataaaataagctgttatttcttcgggtgaccaaaactctgcttctacagggttcaatttagtagtatcaattccattaattaaagtagcttgattttccaaatctccgttcaggaacccagtagaactactcgttgttagcttactgttagattcgactacatccagtccatcagtggctgatagaattgtttcatgcgtaatgctatgttcctcgtctctgcccgaattggtgaaacgatctggtggacctatagagtcgtctttaaactccagtagtgcattgtctatgtcactcattgtattctttaaagacaagtttctttcgatctttccattggcagttctcgaaatagaggcggcggtttcaattggttgcggggttggcagttcactgtttgaatcgttttcactgataaaagtgctggaaagaagaggatcttcattggttaatgggctatatatccttttggtagacttggctctcatcaatgtcggagccttctccactgttatcttttgagtaaagaccaccggatataaaccttcctcattggttctcagatttcgaccaaaataccagccatccttgtattcttcgtcatcagttattactttgatcttgtcaccgggcttcatatctagttcatcttccattcgcttaaaatactcgttaatggcaatatacattgggaaattgccaccgtcacgcccggttgcacttcctttgctgtcaaaatccggtaacaaagtgtccgatacgtctttatctctgctgacagttgtgttgagctgcgagagtgtgggtacttccctgtcattactcatctttatatgttcaaattttttgcggagaagttggtatgattcaataaatatgtggctaaaaatgaaaagttaaaactgaaaaagcagttacagtctttttgaccactctaaaaaaaagtgtaagcagaagggaattacgcaagtagtgttaaaagcaactttaatatctgttgtctttaaaaactgctaggttttatcgtggggctaactatcgcttaaaaggaaagagtaaatatggctagtctaacactaaatattaaaaccagcttttttcaacgcttctaaatagggagaccttactttcttgatgaatttgtcctcatcaatctgagcattttgaatagcggctgtgataagttttgttttttttaaaaaaaaaaaagaaggtctccttcttcgttcataccgcatcgatctagaacgatgggaaaaaaaggcaccacgtgactagagaatcacctttttagcgaaatatttgtttactaccctatgcatcttgcgatgagaagctacatggaaaagggacctataatttagttatcttacaaagtttatttatggaattgtttctcctgtgtttaaaaatatagggatgaaaactcatcggctatactgtcatagacccgtgtggaggaggcagcgcgaccaagtacagcagactggtcacaactaaaccgagctagtggacttggaaagagggtagcttgctgacatgcacacctctccccgggttttggatggacaccatgttttatgccgtggagcgggcacctggtacctctcaaatctctgattcctgcaaaatttccgaaacgtagagtcacgggtcctgacaagcaaccatgctccagagtgattggtttccttgattttttttgctttttcaaaaatttcttaacgtgggttttcttcttcctacttggactcatcccctgaaggtaattctgctgcttatttgggtcacacgcgccctgtagcaacaattcaatcatcctgtcattaagtatatcttgaatatcattacatcttcttttcaataatatttctgctgtaaatgatggctttacattttgtgaacagttattggtatacagaggataaatccaatgtaaattggaggaagagtacgattgccatatattagaaacagccatatacaagcttgaacaaaatacaactcaaagtaaaatggtagctgcacgacaaaaagtaattccttgaattttatttatgttgtacctggtaaccttaattttttttttcttttctttgtaataccttagctctggttatatgtttggtccccttaattgtttatgtacccactacacattaatattgaggggaggattaaatacatgctctgccttgattagtgcctctttttcttttgtcctttttccttcatttatagccatttttgtgtagatggtccaaattcctcggagtgctttgtttaatcagaaaaagtatcaatgagcaggaagcaaaaaaaaaggtaaaaatttaggattgtgctggggttaaagaactctcatctcctgatgaaaacccggctactccatagaatcttcttttgagtatgcctgtaaaacgtactttaataaagagaacactcggttattgacaactagctttttaccttcttcttgacttgctttttccttagaataattaacctcacatcctttaagtacactttacttctacaaagagcgcaatggccgaattgtctacatgttcttgagctattaaccatttgaaataagcatggacaacaaaagacgtgcccacataacgtcatgagggctgtctctggaggttcaaaacaaatcgggcagcgatagtccttggctgcaccatactctttgggtgcttctttggtttcctcctgaaagtcgtcatctgatatttgcaacacttgttgctcttcagcgtctaagtctatggcatctgcagttaaatcaacagtttgttccttactatttgttccagggttcgttgtcggcggtgctgcgtcaagcatcggggaagcactcggagtgtttgctgtttgtgaaagaacgtctattgtgtgcaattcttcaacattatttgttaatgtgatattgttaccagaacttgcttctggctcttcggtatgcattgtttccctgtcatgattcccagaatcgttgttactggtgttatggtcgctacctggatcttcttcaagtgctctaaagagagataaatcatcatcaccatcttcctcagaagtattctcaagagctcgctctccaatgatttcgactacggcctctgggctgtcatggcggttatctgtgacgatattttgtgttctcgatacttcattttcttcctcctcatcgttctgcctgaccgactctagtcttacccttttgattcgtagattttcatcttctggattttggttatcaggtcttcttgccatacaaggtgtaattaatttactcgtttgttacttggccgcccctttatattgactcagtaggggaaaaagtactgttgatcgaagaaagaaagttgttcctactaatcttccgcatgctctaatatctgacatattatcccttctcttctgtaatttcctaaaatacaaatagatgtagaaaacagttctttctttccctgttgtatacatccgtacacttttgtgaacccaaacattttttgtttaatttgaaagattttttttctattaggagccgtctccttcaattctcagcaaagcgagggttcctctcatgcctactgttctcttccccaccggcagctgctgggaaccctccaacatgctgtgcacgggggagggacagtagctaactacctttcacttgggcgggaaactgaaactaatacggtgctgtcccggcttgcgcctctgagacttactggaaggaagcccacggtttcttttcagttggatggagagttataatcaagaagtatatagattttgaatattgattaagcgagtaatattgctatttcgaaataatcgagaaatcacgataataatacagcaaaaatgtcaggtaacggtgctcaaggtacaaaattcagaatttctgtatgttaaaaccgaaacaagtggaaatacccatttaaatcacacaagatgtcgtcaatcaacaaataaaaaagtatattcccgagactgaatgttacaattgagacaagcaatgttcaagaaatgtgggagtcaatcaatgaatatagtggatagccaaaatggaagatgccaaatttatccttaatggcttctccatgcctacatccagatagcgaaatctacttctgggccttaaagcgttaaatggatgcctttccaactgattactgagaaggttacttttgttaagacgattggaagttctatgcggaatatacaaactccaaaaatgtccaattgttgtaagatcatttatgtccaagaaatatatttgtgttgatggttccattcttgccaagataggattgatttactaacagattaattgtgtgctcatttttatgtgtcacttacattttttttaaatagttaggtttaccagttggtgctatcatgaactgtgctgacaacagtggtgccagaaacttgtacatcattgccgtcaaaggttctggttctagattgaacagattaccagccgcctctttgggtgacatggttatggccactgttaaaaagggtaagccagaattgagaaagaaggttatgccagctattgttgtccgtcaagctaagtcttggagaagaagagacggtgtctttttgtacttcgaggacaatgctggtgtcatcgctaatcctaagggtgaaatgaagggttctgccattactggtccagtcggtaaggaatgtgccgacttatggccaagagttgcttccaactctggtgttgttgtttaaataaaatttccaagaaaaattcttttaaatcattatgtaaccttttaaaatattaatataaacaatccaagtcaagtcaatgacatgagagtgcatatagacattgttggagaatatttcagtgaagcggttgcctttttctttgtgaacatcctagagtaaacataatacataagaatgatttttcctacaattacagaactatattcttcaaaacattactgtagagggtcataaaaataggtttctttatttttttcctttgactcgagaatccatgctataagattgttaatcattaacgatgcatttcttctggaccatcgattagttgaacataattgcttggaataatacctgtttcaccgtttgcccttcttgccttccaccatctgccttcaatgtcagagacttgtaggatttcattttgttcaaatgagatttcgtaagcatcatcgtcatcagcgtcgtatgggtacagtgcttttgccttgtaaatgaaattatcatcaccgatatcgctatacagacccaaagtgtctcccatcgtagtttccgtattgccatttgaaaaatcagtatcgaacgtattacctatattagtattggtttgattattgctattatcattggtttccttcgcgttgcttgcgctattgatacgttgttgtagagtgttcaagtgaagattaacggcttctgaagtatttggctgagtattctcaaaaccagccaatgccgtagaagatacataatttgtgtgagaaggttgctgctgtggatatccatcaaactgtgtcgcgtagcctgagtctcgtatagcatcattatagacattattttggtaaggcgttgtgttcctattgcctcttcgacgagctctatgaagagaattctctaatggcgaaggcctgatacccttaatggaaaacgaatcaatccatctattggttggggaagcattatcaccgccgtagtacagaatccagattaaatttatgatggaaagtaagatgacacctgctgaagcagcagctttcttgggaccatccgcatacactaaattcgttgcactgtttgtattatacacaaatgccactgcaatagatgtggtgatgaagattctgtaatgatcgactaaatcaaaacaatagaacagcattaaagaacaaataattagaaattggtatactataccccaccaagtaaaacgtgggaaggattcattggtggatgcagatgagatggagcccccgatggcgatgacccacgatacaattgccaaagaaattgatgatatagcgaaaggatcggcataaaagtttttcattttaaaagaatggtcggtagccatacgtgaaggtttacgaggagttggtcttatctttgatgatattgacatattttgaaaacgtgatttttggtgtttctgaaaagatggcgttgatctataatgtccaatgttgttttcaaattattgggttggctactgttaataacacgccctttcttttagcgattctgttgagcaaagaaagctgatatgatagacaatgatacctcactgaaaacgaggctcaatgactttattcgtgttcctgtgttctttgcatatttcagcaatcgctgaaatttttataatacgtatgaagcaaaagcccgactccgaaagctgttgtgtgtaaatagattgaacgcgttgggaatgtaaaacgcgattaagaatttctgatttaacgcaggtgttaggttattaatagtttcttacgcggatatgtaggttcaagggtctatgtacgtatggaggaatagcaaaaaaagaatgagtatactcttgcttatttagtttagcttcaaagctgcggtcaggcaggtgatcatgattattagcccccagataaacaagagaagacctgtgtatttgaaaatctttgtcgtcaatggcacggctgtcttgtgctcagttcctataagcttgtagccaaagagcccgggcagaatgaaagaaatagaagtggagcctgtggccccaacaatggccagtacacgggccaaggaggaaaccgaaatggcgacaagatatgatgcaactaaaatgctgcacgttataacaataaagctcttgcctctcaatggagtctccttaggctgataaatagattcttcttcaattacctcattgaggtcaaggctactgtcgcgaatcaacggagaactttcggtagcaacagtgggttcatccgccgatgtagcacttatacttacattttcctcggcgaagtgttgcaaaatctgatggattgaagctcttgcaggatgacactgtagtgggaacgccagcatcaccaacagcacaatcgctattctgccgatggtgcttgagaccgcttgcgggtacagcatgataatgtttccaatgatgttgtcgccgaatgtcaggtatccagcacagccgatcgcaatatataagatgagagccaaagatattgctatcagtggaatcttcatcacatgctcgaaccggcttgacctctgctcattgattattgaaaacatattgtggtgacatgtgtaggcaaagacaaaaattggaagagtgtttagcacgttcaaatcatgcgattgtggtggcaggaggtaggagatccggcctttcaagcgaagaatctcatctgatggtgctacatagtgcaacaacaccaaaacacacaagtacgctacagaagagatggccaccatggaagcgtacctcaacgaattcaacttcttcagaaaagacagcggggccacgaaaaaaagcatgatcagtgaaatttgcacgttcctgctcaacagccaagcatttctggtccacacagacattatttggggcatcagatccccaactacaatcatataagagacgcccacaccaaaacacttgatagcgatcgctaggtcaaacacaatacctagatttgggttaatcaaccgcgtcagagcactgaacgaggccctcccctgtggtacgtatttagctacacgagcttgtatgaacaagctttgcatagcgcacgccccacacagcactatcattatcactccaggaattaatccaaacggcttgaatgcgtacggcatggccaggataccagcaccgcacgccgtgtgtaaaagtgtcagcacacctgatctaatactagctaccatatgatgcacgatttctttctatggttattgagctgtgaagctaacccgtcgttcgaccattgttgttctatacacttctagttgctgtatagataagctctccgatcccctaaacgtgcgtggtgatcttactctttcgccctcgtctttttttttcgcttgttgttttcgcaaggtgaatagaatggttttagtagcaaagtgcattgtttattgtgtggtgtggtttgacgcacattctgtgttaatagtgtagcagaagtgtattctacaatctccgcgaacctaagtatgtctgctgttgaaatttcccctgacgtgttggtgtataagtctccattaacggagcaatcgacagaatacgctagtatttccaacaattcagaccaaaccattgcatttaaggtcaagaccacagccccaaagttttactgcgtgagaccaaacgccgcagttgttgctccaggtgaaacaatccaggttcaagttatcttcctgggtttgactgaagagcctgccgcagactttaagtgccgtgacaagttcctggttatcacgttgccttctccttacgacctcaatggcaaggctgttgcagatgtttggtccgacttggaggctgagttcaagcaacaggctatctctaaaaagataaaagtcaaatatttgataagtccagatgtacacccagcacagaaccagaatatacaggaaaacaaggaaactgttgaaccagtagtccaagacagtgagccaaaggaagtgcctgctgtggtaaacgaaaaggaggtccctgctgaaccggaaactcaacctcctgtccaagtaaagaaagaagaggtcccacctgtcgttcagaaaaccgttcctcatgaaaatgagaagcaaacgtccaacagcactccggccccacagaaccagataaaggaagccgcaaccgtacctgcagaaaatgaatcatccagcatgggtatattcatattggttgcactccttatcttggttttaggatggttctacagataatagggagattgaggatatagctgtattctaaatatatatttatatatgtgtgtgttttgccctttccttcctttcagtctttattttactttgtttttctacaatctttttttattgtttccttctgtagcctttacaatactagaacaaggaactaaaagatcatactttcctaacttttttatatgttttattttttaaataggagaataatcgataactataccactgttgtaacatattacttgtttaatttattcatgttcggtttccctagtatagtaggcgctatcttgggtaaataactatccgttattaaccataacaatgcggggtctactaaatgaggggagggtcttggatgcacattaacgaagatcttgcgagggggtcgcgccaaaaaggtccataaataaatgaatacataaacagccacctactttcagtttgtcttttgctaggtctcatagtgaacgagggactcacatattgacaatatagtaacatgggcttatcgcgctggcacgacatgaattcaaggccagcagaggaaaagagcgaagaaatgcaacaggatgcgcactactacgcccttgcggcaagtgatagtttaaatgcaagtgtttctaacgaatatggtaatcaagtaatgaactcgttttggaaagtgggtatagactctccctatgtggacgatgaagcaattagaaacagagatgtcgaaaataacttaccttctttaaagcaaagtgtttataatgctaatgaaccaaatgctacctcgtctgcattttcaaccgcttcatacgcacatgaaactttcgattttagaaaccttaaactaagataaggagggatgaagaataagaataaacgcacgtacaatgcatatacaaccgtttctatgtaccataaatataattatcatataatgaaaaatgagaataaaaaacaatgataacaatgaaaaaaaaaaattcaattaaagagaaaattaaacttattttcttaagtagtcccttaaataactaccgagtttttcagcaccctgttctacaacgtctctcaacatctgcaattcatcatctgcggaggcattaaaatcgatgaaaccgttattagaattacggccatcaaaattacctgctccacttccactactattgatgggattaccaaattcgtccacttctttatcttctccaaaatatgaagaagaggaaattgatgtagcattgtcaaatgttttcaacttgtcatgcgcttccctgtttgctgcttcatcaaatgagccacgaccaaataattgatcagatgatatagctttttgtgtgccgtacctttccgcgattctgcccgtatatcttggtccctgagctattttctgagattctttttgttgctttgccaaatcattggcgtcattcatggtcataccaaatcccaatttggcaaacttgggtgttaaagtatcttgctgttcttttctagttgtgtcgaagctgtttgaagtgtcatttaaaaaatcattgaattcatcaggctgggtattaatatcatctatactgttattattgttgcctttactgttattcataaattgggaatcgtaatcattttgtctaattttggtgctagaagacgaattagtgaactcgtcctccttttcttgttgagcctctttttcaaattgatcaaacaagtcttctgcctgtgatttgtcgactttctttgcggttagtctagtgggctttcttgacgaagacaaaattgaatgtttctttttatcttgcgagtttaataccggtttctttctgcttgccgttaagatggaacttctcgttttagtgacagtggtcttgggtgtgctgcctgtggtgttgtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagagaaaaaatcgtcaacactattttctttggaagtcgacctggaagcgtctgaatcggtgtccaacggtgagtccgaagaatcttgaccgttcaagactaattctgatgggtataactccatatccttttgaaccttcttgtcgagatgtatcttatatttcttagcaacagggctcgtatattttgttttcgcgtcaacatttgctgtatttagtagctgtttcccattgttctttaagaaaaaatcacgagccttatggttcccacccaacttaaaccttcttaaattgttaattgtccatttatctaatgtagaagactttacaaaggtgatatgaacacccatgtttctatgcacagcagagcattgaatacacagcatcacaccaaaaggtaccgaagtccaagtaggattcttgttaccacaatcaaaacaaactcgattttccatgttgctacctagcttctgaaaaacttgttgagtagtctgctccgtggcaaatgtttctccttcatcgttactcattgtcgctatgtgtatactaaattgctcaagaagaccggatcaacaagtacttaacaaataccctttctttgctatcgccttgatctccttttataaaatgccagctaaatcgtgtttacgaagaatagttgttttctttttttttttttcgaaactttaccgtgtcgtcgaatatgaccaaacaatgttacttttccttttgtgtcatagataataccaatattgaaagtaaaattttaaacattctataggtgaattgaaaagggcagcttagagagtaacaggggaacagcattcgtaacatctaggtactggtattatttgctgttttttaaaaaagaaggaaatccgttttgcaagaattgtctgctatttaagggtatacgtgctacggtccgctaatcaaaagtggtatctcattctgaagaaaaagtgtaaaaggacgataaggaaagatgtcccaacgatcttcacaacacattgtaggtattcattatgctgtaggacctaagattggcgaagggtctttcggagtaatatttgagggagagaacattcttcattctggtcaagcgcagaccggtagcaagagggactctagtataataatggcgaacgagccagtcgcaattaaattcgaaccgcgacattcggacgcaccccagttgcgtgacgaatttagagcctataggatattgaatggctgcgttggaattcctcatgcttattattttggtcaagaaggtatgcacaacatcttgattatcgatttactagggccatcattggaagatctctttgagtggtgtggtagaaaattttcagtgaaaacaacctgtatggttgccaagcaaatgattgatagagttagagcaattcatgatcacgacttaatctatcgcgatattaaacccgataactttttaatttctcaatatcaaagaatttcacctgaaggaaaagtcattaaatcatgtgcctcctcttctaataatgatcccaatttaatatacatggttgactttggtatggcaaaacaatatagagatccaagaacgaaacaacatataccataccgtgaacgaaaatcattgagcggtaccgccagatatatgtctattaatactcattttggaagagaacagtcacgtagggatgatttagaatcgctaggtcacgtttttttttatttcttgaggggatccttgccatggcaaggtttgaaagcaccaaacaacaaactgaagtatgaaaagattggtatgactaaacagaaattgaatcctgatgatcttttattgaataatgctattccttatcagtttgccacatatttaaaatatgcacgttccttgaagttcgacgaagatccggattatgactatttaatctcgttaatggatgacgctttgagattaaacgacttaaaggatgatggacactatgactggatggatttgaatggtggtaaaggctggaatatcaagattaatagaagagctaacttgcatggttacggaaatccaaatccaagagtcaatggcaatactgcaagaaacaatgtgaatacgaattcaaagacacgaaatacaacgccagttgcgacacctaagcaacaagctcaaaacagttataacaaggacaattcgaaatccagaatttcttcgaacccgcagagctttactaaacaacaacacgtcttgaaaaaaatcgaacccaatagtaaatatattcctgaaacacattcaaatcttcaacggccaattaaaagtcaaagtcaaacgtacgactccatcagtcatacacaaaattcaccatttgtaccatattcaagttctaaagctaaccctaaaagaagcaataatgagcacaacttaccaaaccactacacaaaccttgcaaataagaatatcaattatcaaagtcaacgaaattacgaacaagaaaatgatgcttattctgatgacgagaatgatacattttgttctaaaatatacaaatattgttgttgctgtttttgttgctgttgataaagcgatttttatacttttctctttttcctttttttttttttgattggctgtttccttatgccgctctttcccaatttatgactttccaataatgtattattttgtttctctttctctctgttaccctttattttatcatctacaataattgaattccggagagggtaaagaaacaggaaaaagaagaaaatgagacatagtcagcatcgtaatcgttttccttctgtatattcctttatcaagagactacacgcacatatatattaatcccggtatgtttttggtgtgctaaatctatcttcaagcactattatagcatttttttaagaatatccaaaatgatatgtaatttatgattaattaaaattcaagaattggagaaaccgtgagcgacttctttgatacttggatgtaagcttttatttagttgctttttcgttttcttttttttacgcccttgttttgcgtgtatactttacttttctaattcacttgagagcgggactatatataaaaaaatgcacaattacaaacttgagaatgaattcatatcgtgaagattttgatattaaattaagaagccaaaaaaacgtaggcaaccataacaaatttcggcattgaacttgattttaaatgctacatacaattacgcgcgctgttttgatatacacacatatatatatatatatacattgtgtaagaaaaattcaaagcttagtaaaacatacagatcatggagaaaaaaaaaaaaatgaatacttgtgataccagaaggatccactgactggacttgggtcacaatttgaatttcattgactttcaccttcatcaaggaggatggtcgttagtaataaagggcattctgagtgacagacaaagaaattatcttcaaagaaatgttactttgattcattgatatgttatttgtttttatttgaaagcactcaaggaaactagacaacagtagtatcaatagtagatccacttaaatgcacatcatttacagaatacatcctctttgtgaagacgacatcctcttggtcatcattcaatctaccttcgctaacagtatttgctgaagaacaatcccaattaccagaatttgagaacatatcatcagatgtttctgtcatactatggtcactctcattggataatgataacatagaagaatcagatattccactcttcccagtaccattaccatcgattattttaccggtatcgacattgaattgaacttgacaaatttgatgtaatcccagttcacaaaaattgtcaagagttactaaacttccatcgtttgccatatcaaggaataaaaatccacatccttttccattggccttagtgtcattgctcttcaagcaaatatttttatcactcataccactcacaataatgtttccacattggaagacttgcttggttaatagtagttcactttcactatctaggctaattgagttaaatccatggactaactcaccatatttcatgttttgtaggttttgtaaatcccaacaaatgacaaagccttggtcatcactgctatataacgcgcctgttttttcgttaaattttagactttcaatgtatcctttcttagcatataattcacaaactggtttaccgtcgcaggattgaatgtcccaaatttgaattttatcgttcaagctctgtgcaacgtgatgattacttatccatacgcaatccaaacttgtgttctttctttgcaaatggtcttttccacatgctgcagatatgctattatctaaaatatctggaatatagagatttgttctcaaatcaagcagcgagatgccatttggtccaaattttgagccaactaaggccagtaagaagggatcatggaattcattaacggcaaaagaatttatacctggatatgattgcaaaaaaataggtgtttttatgcaatcaagatttgatttcaagtcatatataaagagggagtcatttagaagggaaacaaaaccagtcttgttccatggcgaaaccttcaaaataggtgctgtttttggcgttatttccagaatcggaatcgacgttgatacagtagattttagaaacttgttgtggttaaacctttttattattttagcacatcccttatatgttgaagttgctatcagattgactataccgtcttgatgacctgtcaatattaattggttgtggttaggatttatttgagagctggggaaaatctgtggcggaaaatctaccatgggcaataagcagatacaagtaatgggtttaccgggaacagtaatcgtctgtagttccttcagctttttctcagcggaaatttcaaaaagtttcaagttgtctttctcgttcattgtagatactagaagtatattatccacaatggacatgtctgaaggtatggataactcactttcatcaacaccgtacagtttccaataatctgattttaattttttagttgtataatagtcattgaagttgtctgatgcttttcgcaaaatcggtgaattcattttcgaagtattgttttgccacgtttttttgtatgtggataaagtcatcatcgattgtaaaatcctctttttatctgatctcttctttatattaatagcaggctgacgaaaaatatttgttggttcgtagtatttggtatcttgcataatattaatacgtgtcactctcactatcacacctacaatcaaattttttagcaaacacagattaaaatttggaagtcatgcaagaagaagaagccaaaagatagtttgaggaaagcttgggagagatatttctacctttttatatattgtaaaacgtttacgcacttatttatgtaaaccagtaagcacccacccagctatgtcgtcatgactacaaattggttatgaaccaagccttattcagtaaaccagcaaatttaacatcatgccggcattgaatcatacatagaaatcaacacaatagctttgagaactgagaatgtagctttgacgctgctattattatttggtattgtttaccttttaatgtttatttgtttagaaaacagactgctggtttgtttacatttgagagcagaaaaaaaaaattgctggcgcagaccagccgcacagtcacgtgacagtatacgatcatgtgatcttacgtacataatgacattatacgagaaaggggaaaaaacaaaaatttagtggaaatttttggtaaagaccaaattgcagtgatcttcatggtgaaaggtaatattttttgctggcgggggagggggcttctatctcgacaattaaaagacatacgcttaaccatttttagggtactcgagtatcgcatctgctaattgataaaaggactttgttgtgttttgaggctgttttccattttcttcgttagagctacaagagtcgactttttcgttaaacaaaaacgattataagataataagcgctgtcagttttttccacagttttggacttgttactataattcgtgaagcacattttgcaagtgagtcaaaatttcagttcagtccttctttagaagagtgagtgcgtagcaaataaaacagcaggaaataattgcttgtttttgtgtgtaagtaccttttagttggaactaccgaatatagtgttattcgactttcactttcataagccacagctttttcttagtgcgtttttagttcgataaatttaccaaaaactattttccccttttcttattcccttttctttgttagcttgggtattatatttaaagtaacagaaaggaaagaaaaaagaaaaaaatgccttcatccatatccgtcaagttagtggctgcagagtcattatataagagggacgtattccgttccccggatccgtttgctgttctgactattgatggttaccaaaccaaatctacatccgcagcaaagaaaacgttaaatccctactggaatgagactttcaaattcgacgatatcaatgaaaattctattttaaccatccaagtctttgatcaaaagaaatttaaaaagaaggatcaagggtttcttggcgtggttaacgtccgcgtgggtgatgttttgggccatttggatgaagatactgctacatcgagtggtagacctcgtgaagaaactattactcgtgatttaaaaaaatctaatgacggaatggccgtcagcggtaggttgattgttgttttatcaaaactaccttcgtcaagtccgcattcacaagctccttctggccatactgcatcttctagtacgaatacaagttcaactactcgaacaaatggtcattctacttcctccacccgtaatcattcaacgtctcatccttccagaggcaccgcccaagcagtagaatcaactcttcaaagcggtacaacagctgctactaatacggcaacaaccagtcaccgttccaccaattccacatccagtgctaccagacaatactcttcgtttgaagaccagtatggtcgtttaccccctggttgggagagaaggaccgataactttggtcgtacatattacgtcgatcataacacaagaactaccacttggaaacgtccaacgctcgatcaaacagaagccgaacgtggcaaccaattaaatgcaaatactgagttagagagaaggcagcataggggaagaactttacctggtggatcatcagataattcctctgtaacagttcaagtgggaggtggttccaatatacctcctgttaatggtgcagcagcagcagcgtttgcagctacaggtggtaccacatctggtttaggcgaattaccttcaggctgggagcagcgatttactccagaaggaagggcttatttcgttgaccataatactagaacaaccacttgggtggatccaaggagacaacagtatatacgtacttatggccctacaaataccaccattcagcaacaaccggtctcccaattaggtcctttgccttctggatgggaaatgagattgaccaatacggcacgtgtatatttcgttgaccacaatacaaaaacaacgacctgggatgacccaagacttccatcatcgctagaccaaaatgttccacaatacaagcgtgacttcagacgtaaggttatttatttcaggtcccagcccgctcttagaatattgccgggacaatgtcatattaaagtacgtagaaagaacatttttgaggatgcttatcaagaaattatgagacaaaccccagaagatttaaagaaaagattaatgatcaagtttgatggtgaggaaggtttagattacggtggtgtttccagagaatttttctttttattatcacatgagatgtttaatccattttattgtttgtttgaatattctgcgtatgacaactataccattcaaataaatcctaacagtggcatcaaccccgaacatttgaactatttcaaattcattggtagagttgtgggtcttggtgttttccatagaagatttttggatgcattctttgtaggtgcactttacaaaatgatgctacgtaaaaaagtcgtattgcaagatatggaaggtgttgacgcagaggtgtataactcattaaactggatgcttgagaatagtatagatggtgtcttggatctgacgttcagtgccgacgatgaaagattcggtgaagttgtaacagtggatttgaagccagatgggagaaatattgaagttactgatggtaataagaaagaatatgtcgaattatatacccaatggagaattgttgatagagttcaagaacaatttaaggcattcatggatggttttaacgaattaatccccgaagacttagtaactgtgtttgatgagcgtgaactagaactattgatcggtggtattgcggaaattgacattgaagattggaagaaacacactgattatcgtggttaccaagagtcagacgaggtcattcaatggttttggaagtgtgtcagtgaatgggataatgaacaaagagcccgtttattgcagttcaccactggtacttctcgtatacctgtcaacgggtttaaagatttgcaaggctctgatggtccaagaagattcactattgaaaaagctggtgaagtacaacaattgccaaaatctcacacatgttttaacagagttgatttgccacaatacgttgattatgacagcatgaaacagaagctaacattggccgtggaagaaaccatagggtttggtcaagaatgattattccgcaccaatttttttttttatttatggtgtccgttttcccaacattctttctgcctcaatcatcttgttttatatttcagctaacaatagtaaagagaaaactcttttttgttaattttatctgagttgctcatgaaatgattaatcattgttgtttttacagcaacatggaaagcagcaaagaaaatgcaggaaaacgtgaagtgctttttttgatgattacgcaaagttcttttcaagttcgccataagaggaggttttccttttcgaaaggagcatgataccaataatttatattgccttacgcctcttattttttatatcctctttttagattttattaatgtttttttttatttatatacatataatgtgccctgctttttacaaccatacgttttttgttttttaattttcttgcattttaaaactgaatagtgacctgggtattatactacagttgaaattgctctcgtgaggtacatacctgaaacgagcgtactagacaatccctctcttgccagtcacctacacacaaagagtatcggttatttgtcgtgaggaaaaaagaaccggataataaattcttgatttgttatattgtacagaaaatgacgagaagtaaaaagagaaacccgaacaggacagagcgtacatattttatatacctgttcttttgtgcttgtagacgtatatcgtattattaaattaaaagtaaacctaatttgaaccatcgagataaaaaaaaaaacggagcacttttttgctcatacaagcaaaaccgcattgacacagccgtctctgtctggttcgtttgtgacctgagcatacttaccccagacaactttaccaccagcagtaaccatccccaattccgaaacgttaacttcaataatggtacctttagtcaaaacacctaactgagtgtacattggagattgtggattcttcttaactgccaaaattggcaagaagacagttacacctaattccggatgagtgacgtttgcctttttctgtctcaacgcacttggtctgatgattctttccattttaactggtcttctagtgaaaccttcacccacaaaagtgtgtttcgttatcattctcttccatgacttggatctagatttacctgttttaataactttgaacatttcttcttcacttataccacgaacctttggtaacggaactgaaaacttatcagctttttccaacctcttttgtttgatagatgaagaaatagctttggctgtgttattttgttctctgtccaatagatatgtcggcaaagcatcaccatcggtatccaatggtttggatgaacccttgaccttagattgttcatgtgccttaatcttctttctcattgataccttttcagcatatctcttcttagcaaattgcttacccttccaaccagtcaacttctgggcccgttcagaaatcttatgagactctcttgcctctctcttacgtttcctttcttcgtgatctaatcttttaccatgctgtttgatgtgacgctcgatataatcgttttgaggcattgtttcgttgaatatatcagtattgatacgagactgactactgactaaagataaaaacgccaggtacgaaaaccaagttcttctctaactgatacctaatccattcaattgtcttaaaagtgcatctcatcgctgtccggaaaatttttcatcggattgttactagaaccgttgccgacgacataaaattttttacgcctttcctgcaaggttgaagaaaagaaaccgatgagctataccattctaaagtgtcaatgagatgaagaaattaaaattgtcaactaacacacaaatccaagaatgtctgaacttaatgcattattaaaagatatcaacggctcgctcactgcgacatcagaatccttggagaggttgtctgggatttatagtaattctgcgaccgatgagattcctgaaagtaaccaactacatgagcatctattttacgacgctaagaagcccgctgagaaagtatcgctgctatccttaaaaaatgggagcatgctagggtacataaattctctattgatgcttataggtaataggctagacgacgagtgcaaagatccttctgctatggatgcacgtgaacgctctatccaacaccgtgtggtattagagcgtggtgttaaaccactagaaaaaaagttggcttaccaattggacaagctgactagagcatatgtgaaaatggaaaaggaatataaagacgctgagaagcgtgcactggaaaaatctaccttagtgaatcatagcggcaacgacgatagcgaagatgatgagtctagtgaggatgaaatagcatacaggccaaatacctctggaattatcaacacaaataaaaaatcatcagcatacagggtggaggaaacggctaagcaagaaaacgaggaagaaaacgatgacaatgagactggcgtgtataaaccaccaaagattacggctgttctaccaccgcaacaaacgcattttgaagatagattcgatgccagagaacacaaagatcgtagtaacaaatcgcgtatgcaagccatggaagaatatattagagagtcatcggaccaaccggactggagtgcatctattggtgctgacattgtgaaccatggaagaggcggtatcaaatcttcgagagacacagagaaggaacgtagagtcacttcattcgaagaagataattttaccagattgaatattacaaataaagctgaaaaaaggaagcaaaagcaaagagaaagaaatgcaaggatgaacgttatcggtggtgaagattttggtatattcagctcaaagaggaagctggtagatagcacttcgagacgtggggccaagaagactcgttctgcctgggatagagctcaaaggagactgtagatacaaaaagtttattttcttatatcctaaagcgtttatagacttaatatttaaaagttaaatataaatgaagggcactggtatataagctattaaaaacaatgattttggctttcacgacattaacgtgtgagaggtttaggcaccattgcctttatgattattagtccctccagaataaactctacctttttttttcttttttttttttatagtcctaagcagaacatgactaaatcgccataaattaacaatatagtgggaataaggcacaccagaagtgccacgatatagtatatatacaatgataaatgagtacgttgccagaaaggtcgctctcaaggacatgcaaccatgtgcgatctgtagcaaaccatccactaccgtcctttacaacgcatctggtccagattggctatatacatgcgaaatacatttacaagataatccacaatttgtcattcccctctatagtacagagtataatgaagccgtggctcaattaaaactagtaaaggggaaaatggatagtctgacatcagctcaaacccaattagggtcctgggatggttgggttactaaaatattctccaagaaagaaaaggagacaaataactctaaagaccctgatccaactacaaccgactctactgatacatctccacaggctaagaacgatgcagaaatcttgtcagaaacaaagaaacagtacagcaaaatacttgacaaagttacagaactgcaaaggaaaaacagaaaatacgaactagcaaaaatcatgtttgaaagcagactcctaagaaaaagaacagaacaagtaaatcgcgaacgatacctcaaggagcaagagaattactctaatacggatcctgaagaactgcttcgaaaacacgtgttcccctccgttccaaaataaggacgcaacggttggaccgttcctcttcctatggcctaataccaatgaactattgattatatagtatataaaattcaccatggattatctattcatggttcgtaatcaaaaactaaatgctcatcacattctaaagatcacaaaataaaatcaacacgtatcaagcgactaaattgtagctaatttttttctttctttccagggaaggcagaaagtgtgagtgatgtttgtatttctgacaagctgttgagagcaggcaaatggtgcttcatcaagttaaataatcatcgttgaacgacttcaaattaacagcggcttgtttcttcgttcccttcatattcatcgctgagcgtagaaagctaacgtattactcttttttttggaaagggagtcaattgacgcttaaagactagtcattttgtttagaaaaagtcttatatttatttctgcaggtggaaacatactagcatatggaaaaagtttaggtaacgaattttgatcaaactaaatctcacttctgaactgactacatattctttatttaaggagttgacatttttcatttatccagtcacaattttaaaagcacttcgttaacacgtttggttgtccttatttttgcattgtgattatatcaggcggcattaagtgaagtataccttgtgacctgaagatttactttggaaagtaattgatgttttaagacagtaccggtttcctttttttttatttggattttttgtcagtaagaatttgtaattatagattaagataaaacgaaaagaagcatattaataaggagttttgaacatggataggagtgataaaaaagttaacgttgaagaggtcgatgtaccttcaaacttacaaatagaattagaaaaatcaggcaccagtagcagtgtatcactccgaagcccgactaagagtagcgctaccaatttggcgggcatggccgaaggtgcaagagataatgcatcaatagcgtcttcatcggtagattccctcaacatgctattagagcggcaaagagtaaggcaattaaaccatccacagcaccaacagcatataagtagttcactagctaagaccccgacaacgacttcatcattttgttcgagcgggagttctaagaataaagttaaggaaactaatcgaatatctctaacatacgacccggtgtcaaagaggaaagttttaaacacttatgagatcatcaaagaattaggccatggacaacatggaaaagtaaaattagcaagagatatattgagtaagcaattagtagcgattaaaatagtggatagacatgaaaagaaacagaggaagtttttcacgtttatcaaatcaagtaaaatatccgaaaatgataaaataaaacgagaaattgccattatgaaaaaatgccatcacaaacatgtcgtacaactgatagaagtcctggatgatttaaaatcaagaaaaatttatttagttctagagtattgttctcgaggcgaggtaaaatggtgtccaccggattgtatggaatcagatgctaagggtccctctttactaagttttcaagaaacgcgagagattttaagaggcgttgtgctcggcttagaatatctccattaccaaggaatcattcaccgagatattaagcctgccaacttattaatatcaggagatggcactgttaagatttccgattttggtgtttctttagctgctagcagcacgaatagttccgatagtagcgaatccttagacgagttagaattagccaaaacagtgggcacgcctgcattttttgctcccgaaatgtgcttgggtgaagatgcattcaccaggtataacttaacaaaggaaaatttatttcgtggttcttgcatctcattcatgatagatatttgggctgtgggtgtgaccttgtactgtcttctttttggaatgctgccttttttttctgattttgagctcaaattatttgaaaaaattgtaaacgacccgttaaaatttccaacatttaaagaaatacagtccaacaaggtatctaaagtatcttgtgaggaggaatacgaaatggcaaaggaccttttattgaaattgttagaaaaaaatccccaaaaaagaatgactatacctgccattaaaaaacatccttttgtttcatgggattttgaccacgtaccggagaacgatgaaaagttactatcttctgtccttgagcaaaaattacgtttccaatgtaaccaaactgatcaatttgaacccatttctatttcaaagcacgaattgaaaaacgctgtctccggtgtcgggaaaaaaatcaaagaatccgtactaaaaagtatcccgctaaaggatccgtcagatctctctaataaaaactaccttcatccaacggaaaccgctaggagcagaggggatgccaatgttattgtcagcgaaggttcagtgttatcgaatattaaggaattaagtgctaatgatggatgtttgaacactgatagcgacactaatattaatatcaacgacgatgatcattatagtggtgatgataacgatggacatttaacgaaaagagaactagaacgagaattaaacaaattcgatgataaacacgaggccggaaatatggttaatttgcctatcaattcctcatttgcatccttggacagcttctacatagataattttgcgatggctagaatgggaatgagttctccagaagcgggagattcggtttcttctgtaccaaaccttccttctgcaccgtcttcaacaaggcttggacgatcaccagtctttagtggagtcaccaaccaaccaagtccaattcgccccgttttgccacaacaaaagtcatcgttttgtgcaacaggtcggtatgataagagtcacaatagtcttcttagaaattcttcatctcatctaacgtcatacaactccggcagaccatcttcaaggactggccgaatgaattcacgcaaccaaaacttaccgaaaataccaaatagcctttcaaaaatctcaacaacgaaattgactgaactaagagttccaaaggattcagaaatgccatcacctgcaaaaaaccctaacgctgatcatttgagaaggtttcccgtaaagaaaaataccaaaacacccgccataaaagatcctccgagaagaaacattaatagcagcgataagtcaggctccaaaaattctcctataaaatccttataccaacggatgaaacagtctaaggataattcaaaaaccttcgaggtacgtagaggaaactttttcagtcattttaatggagatgatgatgatagcagtagccagtcgtccgtaaccagttctggttcagaatctgattcagaattatcatccacttcatcgtcctgtacatctggaacccaatctcggaatagctccaacaataatgcatattcagaaacggagtcattacctttcgagtttggtgttgattcagaagatggaagtggagtattattaagagatttacctaacgaagatcaaataaggccgtttctggatatacaaccatgtcgacgcatgaaagttaaaagctcattgaacctcgaaccaccttctgtctcatcttcttcatcttcatcctccgacgaagatgagctaattttaaatgtcgggactgcaggtcatcgaagaaggcataattcttcaaaacttagtgaactatccaacagtccgcagaagggatcaaataacttcatgtattccaatggaagtgttcatgacagtgagacgacgataacgccgcaaaatatggatgacctgacgctgcatcgggcactgagccgtagccaacccattagtaagcctggcccattagtattaccaaagcgtttagaccaaaagaaagctacgacggaaacctcaaatttgacagatatcgttgaatttaacggtaataacgatcatcgaaaggacaaaaatttcggtaaagttctttattcaagggacttgttaaaagatgctctaagttcaactaatgcaggcagaaggagatccataccttcaaataaaataagaggacgaaaggacgcaagtattaccatgagtactaatgttggtaatgatgaacatgctagaaataccagctgcaatggtgataaaggacaagaaaacggcgctataaaacaaaggacccatgaaagatcgcgatctttaacagtcgctgaactaaatgaagagaagagaaggagtgcacttccatgagtgtaaaattcaaagtaatttccatcggactacgatgccaacatgcacgcatatatgtgtatgttaaaataagttctgtatttgaaatgcatgtgatttacaatcctcttgcaatgaacttaatatcattaacaggctaaaaataatatatgatgtagatctttttagtttagcataatataatctataaatctataatatttttattctaaattattaaaagggcggcgagagaagtgtatctgtgcttagaaaacttttcgtttcttcgtctcatcctgagaagtgtcttttcgtttcaaaatcattactggtgagtgtcattaaactttttcaatttgcaatttccgtatctttaaaattccataaggaagcgtgagttttaacgtgctgattcaaattatcgcttctgctgaagttcttattacagatatggcatgtaaatggtttttcgcacatatgtaaagatctgacatgcctcttcaaatgctcttgtcttttaaatcttctatcgcaaaattcacaaccaaattgcttggaagcgtccggaattaaagagggcttccttccgcgcgtcttctgcatgcttcctgtcttcttcctcaccactaagccatgagaagaagaggaagattgtactgaaggtgatggtgcagaaggagaaggagaagtggatggttctgatatggcagccaataagtcctttctcgaatcattgctgaattttgaaactggctcaatcatcttaaaatcactgccagacttaaatggattcgttgtcttagcaatgctttgagtagagatatccttgttatttcccaccagctttaacggatttattatcgcgtggtcactctcatcactttcttcattagaggaaacgtcaaaccctgaatttataagcacttcattttcttgctcaagaggaagagacttgattagagtgcttttcctacttctgaagaatctatttttgaacattttctgcgaggaagagttttcggtctgaatgggttcacaaccaaggctattactgttattattactactgctactactgccgaatatgtttaatttgaaatagtccctaactttttttttagattggggcacagtggtaaaagagtcttcaagctcatcgtcaatgttttccgttggatctattataaattcatgtatctccagatttttcaagttattagtactggaaatcctgttcagcccgtcaagaggctgttgcttgagaaaggaaaatctttcatttacctctaactcgtcgtcgctaaccatcaatacatcactttcattatttagatcgatgtcatcatcattttctacgatgtcgttattaaataatggttcgttaagttccctcctaccaaaaaactcgtattcgtagtagttaccgttttcggtacgatagtcggatattgaaagccttctctccaactgatttgatgaagtagctgtagttacacaattgtcgacaatagtattgcctgttagatcgttgataatttctacattattattgtcaatttccttggcattggcgttggcatttggtatgagttgaagggtaaaatgttgcttgtcgttattgcggctttcgttaaacagctcagtcttagaattcaaagtgtaactgaaaaccgtgtcatttgattcaaatctttgtaaagggtataaagacatgcttgtctgtctatgttatcgtaaagctttatttgtccctggatagtttatgaagtctagcaggcctactgtacaaattcaaaacagaaaatcatcatcttgctcgaagccagcccatgctacctatggctctcagtcgcccattcagctatctatatatatcttgcatggccacgctaggaaccgcgccgggcaacaacttgggcaaaagccctcggaacagtaaaagccacctttccgtgggttatccgctgaaattttttgctccatttccgaagcgtcgcactcgtaaccgtaaatgtaaaaaaacagcacccaattgggccatgtgtgattaacgccgggcggctatgcacgtttgaacaagtatatccgcatggagcaacaactgctataagaaattccgtcagagaaatggcttgacttgctgcaagcacagaggtgtttatggataatatgtatacaataacctcataggtgtttggcagtgtgaattcactgttccctgcgttcccggaatggagaaaggggtatgacaggcgccaaaaaaaaaaacactgaaaaacaagagaaaagagtaaaggagatggcttgaatataatatttattccttgctaagtttaatagcgtattttcttatattaattccgtggacgatcagatgcgggaatacaatgttggcagttatctgtttcatcgctccctccttgcgtaaatatcgaaccttctatcattcgataatcaagaattaaaactgacagccgcgccttttcggcatcttctggggttgatcaaaattataataagaggactgctgcatatttacctccgtacaccttctacacccaaccttattatggggcctactaaattttcttttgagaagaattgcgttcttttcatcgtgttgtgttttttgagatctttcgcgcgatggcatctcacattcgcaatttgcatgaaatttcagatagtattgacagcattcgatcgtgcaccgggaaataacgctaggcgtctatcgtaacataacagagtgttttattatctatatagtgatatttaccttaaattcttgctcttaagcgtgtctcaatttactttcaaaaagaaagataaatacacataatcaaacaggaaaagtatgttataagagcgaataatgtgataaaggagcaaagtggaaggaaagaattataaagaatgacgttgccgtaaagccaattttcaaccaacaaaattgcaatagtttcaagcaaattatggtgtgtccgggattggcggtagtaaattgtaaaacaatagctggtcaatagttgatattcataccgacactataatccacaaaagatgggtgacattgatggctgaaatggtggaggcaagaaaattttttaaagcaataaggcatagacgtttctattaatcctttgttttattcagtattttcgatatttcctctttactaacttcaatttactgaatttgtatgtaatttttagatgccaaaaaagagagcttccaacggtagaaacaagaagggtagaggtcacgtcaagccagtgagatgtgttaactgttccaagtccattccaaaggataaggctatcaagagaatggctattagaaacattgttgaagctgctgccgtcagagatttgtccgaagcttctgtctacccagaatacgccttgccaaagacttacaacaagttgcactactgtgtctcctgtgctattcacgccagaattgttagagttagatccagagaagacagaaagaacagagctcctccacaaagaccaagatttaacagggataacaaagtttctccagcagctgccgcaaagaaagctttgtaaatatgatgagagaataatataaatcaaacgctcgctgattaaggtgtcatttattttttttaatagaggctttgtcttttataattgtgtattttaataatatgattatagtatattttcaagaatagaatttttgcgcatgcaacttcgttcatactcaattcacagtaggcagctgtatttgtatccgtactactggcgtacgtgcgatgaattaatcgtatcctacggcaccttgtaagcagtcgagaaatttttttttcactttttccttttcatacctatataaatagaagtgttcttgtcgatttgaagaaggtttatttcgtttcgctgtagtttttttgtcattgatctttccatttttttatttcaaaatccccatcaactattacagtcgatgaggataggttatagttcatgtgtaacatctgtgttttaaaataactctagttatccggggcgtttttcacaaagtttgtgtaagatgctttcctgggtcgatgtggattgtgccgtggcctttttcaccacctttatagcggtgctttaactattaataactgaggctgtattttgaattcttacgtaaatcttggaatctatggagcatccagtctcacctgggttggctctggtaacgcatgacttggtatgaaaaaattgttttaatttgacgaggaaattttgacatccgtgaagttcaatacttccttaagtattggttttcaaaaaaaaaaattctaaaattctagaattcttctattataccaaagttataacgtctataaatatctataactgaaacctgttttgtcataataccttgttttagttgtgcttttttttgctttatctggatattatctaatatgtttatcttcgtttaccgaaaaaaggaaatggggcaatattatcgttatcatttgtagttgcgtcttctttcctatttgttctgttggcagtcgctgatctatcctcacaatgcccttcactctccttacgtccagtattcactgcaggaggcataaaggcaggattcatgaatagagcagatgtggaatgtgtcgtctgagtactgaatcttttattcatatgttgtctccgttgttgagatgcagtgaaatctgtaacggaagtcctaggtgagatctgagtggaaggcgcctgtgagaatttgatggacgatttcctgaatccctccgagatcggggaacttgatgcaaattttaaagctggtcttgtattttcttgctgttttaacggtgtcgcgacatcagagtgctgcctacttagagtaggagaagaagatccgcgtgcaaaaattggttttccagtctctctcatttcgtcatccatttgtgaaatgtcttgtaatacctttttttttaactttttcaagactttggataattcgattgcttccttcgtgcgcgtcatcaagttactgtcattaaccaatacagaagttctataaatagacttcatgacatagtcgacaggtggtagtgcattgggtgacaccatattttccaggctagatatattaacatattccgaaccatcttctctttgtgaattaggtctaatgtatttggaaaatgatccatgtaatcttgaagagtctggagtgctggatcctattttatataaaggatcaatagaatcatcaaattcttgagatgtctgctcctgtaattttttattcatttttgtgaaaggcaaaatacctagctgtgaatcaaggtcatcagaatcagagcggaaggaagaacctgaatcactatcaaaactatcacgaataaacgggtctgtctctaaattggatgagttttgaggtatttctgttcctctgttcttcaatggatcattagtgcggtctaaatctttcccatcgttgctgtttctcttttgcaacgtttcaaccttgtgtttatcgaagttcgaaatgtcctggagcgtagcttgttcgttttgttcctctttatcgtccgaagctctgtttgacttactagagtcaaaattttggtaattatgtctcgtaggttctgtgggaactgtttcagtaaaactactacttcttcttggaaagttctgttgccggctgactggtccactatcgggaacatcatcagtaaattgatcggaggtatctaatggatctgtttctctacttaagctggatttcttcttcgtcgcttggctaaataaggacacagagcggcgaatattttgaacacccgaattactggggaatgcaattgaaccaatcgaattatggctgtctctaggaccaccggcaaaaacagtaggaacagccctattggcaagcgatcctatgctagaaattcccgtgtggtgcatatctatttcggtttctccattactgtcatccgtgtagtgtattgattgcgccattgaagtgtttcgcaaaagatatgaatcaacgtatccgttgtctatattggctagggaacgttttatctctaaggtgtcctggtatgattcgctagaatccaactgctttcttattttgccctcattttcattgcaatatctcgaaaccttttgctggaacagatttagtagtgcttcgcaagtaactgaaagaccttcttcctttttgcttattatcttatacagcacttccgtaatcagttcgtataaaattggaatttcgtatattttagccatgataagcaggtccagggtcacaggagctaatagccatttgccattaatttgtgcggtgtaaaagaactctgcaaatgctcttacagaggcggtcgaccaaggcatatacaatgatctcggggttaataagggttctaactcgattatggcgttattgttcgaatttgtactttctacactttcagggtttgaaatgtaagaaagtcttctactcttttcattattaatatatgattttgaagaaaaaaattcaccttctttgaaattgccgtttatattgattgcattaatggtggaaaagatgggccttatattggaaggtgagatacagccgtagtcttgattgtccccatcttcctcttcatctcttccattgttcatgccatattcttgaatacttgcttcgtaaggaatgtcactgccataactattacttagcagttgcgaatctagagtattcctcagcaaagaagagttagagatacgccttgcatccgaggagctcgattttctggtggaatgagaagaccttcttgacgcgactggactatccctaccaaattgaacgtactccgccaaggaactgcttcttcttgagggtgcttttggcaccggcggtagaggttctagtgggatcttttcttgtgggggtaatgggatattcaacacaggcaagataggcgagtttggtaaacttgcagagcttcctaaatgagaaatttggttagagttgcgccttcttcctgaagtagaacttacaacagaggcagtgctggcagtagatgcaaatgaagtctgtcgcgactgatttggacttgctataaaccttaatgcggatgattttctacgtgagaaagctttttccgcgggactagcctttgatatactactgggtgaagatttggctataatgtgagattgaagagggtgtgaggctctccgaatggatgaaaagccgtcatctaccgaactattcgtggtggttcccactgtggaagctcgcctataaactaaaggtgtattggaaagtgtacaattgctatcattaccatcgttagttgattttttatataccggaggaggtgaaacagagcttgctcgagtagagcgaccagactgttctgaaagccccagctttgaatttttcatgtcctgaaagggaaccctaaagaccatacctgtagaagagcaagtggtggatatcggccttttgttcgaggtacctgtttctttcaggccagtatcgccagttgcatgttgttttaacgtgtttgaccgactgtcctcctcatccgcacaaagtatcggttctgaaggagatagtttattatgcgagatggctcgctgcttgggtgacgatgttgatgaagtaaagtctacgctatgtggtttcttaagacttgtattactgttcgatttactatttccgtttttagaaaagtatttttctagggatccgttggatgattgactagagttaccaaacttggtagtttttgagactgtatgaggtgaaaaacttatgatattagaagtgtctccattaaactcataattgaaagatgtatttgcatagccgtttgataacagtgaatcaaaatatcttccccatctttttctcaataaatatactggaacgccgatagaatcaccatcagcagtgataaattcgaaatcagataaagccttgccgaatatttctagagcatctttacctaaaaccatagcatatggcggaaatatagaactagttgattccatttctaatggtacagttatatatctggaatagttctcaaattgtgaggtcgcagtcgaagtcaagcgggggatccctgagtcgtctaaggaatacccttgagttactgtgtatggatttgtgtgctcaatcgttgatgaattagagtatggaagatgatcataaagacttagatttacgtttgagttatgactattagcgatgccattattagtgcgtgtgtgtttggtattcactaatttattatagccgtttaacattggtaaagagaatgataaaatgtgatcgaatttttgaacgctaggtgaacaaaaatcatctgttctggtgccaagtaataaagcttgatgatgagacttccaaatcagaagcttccaaaatctatgcatactaatactgcactcagtacatgctatgtttactcttatccattttccactagcgatattataaatgaaacaatgaagattggaaggttgggggtctggataaaatcctattacaacaatgttataattaaagtaattacctgagggatactgcaagtgaaaaggtacttgtaaaatagagttttctttgttgttttgtgtagggtttgatgtcatcctagcgccctgagagtttccaagtagtggcaaaattatgataggcgacataagtgtttttactgcgttttcatctgcatcatcgctttccaaatatttaagatcgccatgatggtgatggtgatgttttggtagtttggatttgtcgtctagatcatgagcgtaagtagagaaactaccatcgtcggttccccttctggacgtgtttgcctcgcgttgggggtaatataatgccaatgtcggaatttctgcctgattattttcaatcagaactgagaagttggaatcgtgagataaagaaattggcatcccatcaatattaaccagtatttttgacgacccctttgaagctgggttttcgtccgatttcgattctgactcccataaacttgtacgtaggttaaatatatcaatttttttaacaggaatatccatattatctaacccacctactatgattagcttcgtatcttgattttcgttattttcatttaggacgtgcatactatgattaaaacgtcttgtaatttgagggttttcacttatcaaagaccagcactttgttttaagatctaatttccataattcgtttgttgctatcagctcatagccgttgtgaggcgacaccataagcccaccaaaaatgtaaatgttggattctgtaaagcacatcgaatgaaacaatctctctttaaagcttaagccgttattcaactcattttctgatgtagtatctattgtagtatttattctttgccatgttctggaaattaaatcaaggaaaaatatctcagggcttatccaatcagctaatgttttaaaatcagcatttctatccttctgtttaccaaaatatagaattagctccttttgcagttgtaatgaatttataatagtcagatttaaaggtagtgtgagcccaccatggacaaaaacacctgaacgggctagttctactgtagctccagttctgcattccaaagtgagcttcttccttgttgcttcatccagattgggattcggtacaatagggaggttgagcggataacaaacactagatggtggttgtaatacggtcattttttaaaactttatgctttcacctaattatagaaacgcgtactaatgttttttgttattgaagaaactggaaatgactaaagaatactcaggcaacgatgagcatagccaaaaaaaaaaaaaagtttgttaaaagtgatactggtagctttaatacaatatccaaagttgatgatatcaagttggaaacggtgtcgatgtgaactttgttagaggttaatctgtatttgtgactgggctctgccaaacttactatcttctattatctaggctcaagtaagtaagatgaaaaaaagaaaaagaaaaaaaagcagaaaaaaagcagaaaaaacagtaaagtgggtgtgagtgcactggaaagcctgtgtaataggtttttgatgtactatattccttgcgagtattatcacaaagctctactgtgtttgcactgtgtgcgtatagggataccgcgagggcaacgcaaaactagcaagaaacacatattccatacattaaagcggtaatttttagtagtcaatttcgaaatttcaaacccggcaatgatacgcacattaagaaaagggaaaaaaaaaagaataaattggccatagaaaaattatgttatccactagacagaagtttgcgttccatactgtcagaggtggcattttacataacaataatgacaaaaaataaatttcagaaggaaggcaacataagtttttctaatcctaaaatctttcgattttgtatcagagattgttcacgctaatgtcattcatcatagtagattatttatctttcactgcggagaagtttcgaacgccgaaacatgcgcaccaactttcacttctacagcgtttgaccaaaatcttttgaacagaacattgtagggtgtgaaaaaatgcgcacctttaccgctagcccaagagggcactacaaaatctagagttgtacttcaaacgtacatgtaatcaccttgtatatactcgaaagaaaacatcaagtttctgtataaatattagtgaaagcataatcatacattatcttttcaaagaattacagttagtggctgtttgctgacatttcattgcttcccttacaacctgatttccattcgagttgaaaggttgagaaaaattgcaagacttctctctcatctaccttcccttttcttgaagacaaggtgagagacaatttagtactaaagcttttgcggttgttattcaattgaggtagatacctggcaaaacatttcttgtgagcacaacctcaattaaagttagacaagtaggtgcactattggttgcttgttggctcatctcgttgaggaatgtaataactacttgttattaacctgtttttgtgccatctatagtggagagcttattgcaatttgttttttatttcttgactgcatatatcagtctttgacaggctgcatggggatgacagttagaaactagccaaattaccccttatgtagataacaatcattgcttattcgctcttcccccattttttttcttgctcttgctgttttttcttttagcgttcgtttcaaggaacaagagagggaaaaaaaaatcaaaagtagaaaagaagaagaaaaaacaacgtaacacaagttaacaccacaactgaaaaaaaaataagaggtgaacgaacgagtaactggggagaggaaagcagattaccacaatatacattcaaattaaagaaatggactcacaaccagttgacgttgataatatcatcgatagattattggaagtaagaggatctaaacctggtcaacaagttgatctagaagagaatgaaatcagatacttatgttcgaaagccagatctatattcataaagcaacccattttactagagttagaagccccaattaaagtatgttaatgttgaacttcgcagtcaagagatagaatgcctagagcttcaggtgttttatgtgttctactcctgttgcggcagtaagatagttacagcagttatttccgtttgactgaaagaatttaccaagcatctgatgttagcctactcatatgtcgagatagccgagataatgtgtgtgtttagctcttcatttttctatcttattaggcatttttttaccaagatttccttatgttttgtatcatcatccggccggcgcctcccatattcagaaaaatcccccttgctcacactaaaaaaagaaggcattttttcgttatgaagaaaacgaatcttttttttttttgagcccgagagaaaggtcggacgaaaaccaagaaatgtggatttgcagaaggcattgggagaaatgaagcgtttttgacagcagtaattgttctcttaaagtcaacggaatgagctagatttagtgacaaattcatttactaacttatttttttctatttttttttttttagatatgtggtgacattcatgggcaatactatgatttactacgtctatttgagtacggtggattcccgccagaatctaattatctatttttgggtgattatgtcgaccgtggtaaacaatccttagagactatttgtctattactggcttacaaaattaagtatccagaaaactttttcattttaagagggaaccatgaatgtgcttccattaatagaatttacgggttttatgatgaatgtaagagacgttataatatcaaactttggaaaactttcacggattgtttcaattgtttaccaattgctgcaattattgatgagaaaatcttctgtatgcatggtggtctctcaccagatttgaatagtatggaacagatcagaagggtgatgaggccaacagatattcccgacgttggcttattatgtgacttattgtggtcagatccagataaagatatcgtaggttggagtgaaaatgatagaggtgtttctttcacttttggtcctgatgtagtgaacagatttttacagaaacaagatatggagttgatttgcagggcccatcaagttgtggaagatggttatgaattctttagtaaaagacaattggtgacacttttcagtgctccgaattattgtggtgaatttgataacgctggtgcaatgatgagtgttgatgaaagtttattatgttcttttcaaattttaaagccagcccaaaaaagtctaccaaggcaagctgggggtagaaagaaaaaataaatagattcacgtcctaaatcaaagtttaaaaaggaaaatacttattaacaagaagagtagtagaagaaaaatacaagaaacataaacgtagaaaacttttagtcaattctttaagcgaagaatacgaaagaaacatcaagaaaacaaaggaagatgcaatcatcactcgtcatatacacaaataattccctttagtgcaacaaaccgcgaaaaagcataagaaacataaaaaaaatataaaaaaaaggagataataataagatgtgaaggatttgaattagtggaaaaatgataagtctacactattattattaacgaaatgcaatttttctttattttcttttattactattatcattactattattattagtattattatttttttacttatttttatattaaactatgttaaattactatattattattttgtctaactctatattgaggctgtctttcgttgcactgttaagaatggtcacgtcttcctttggctttgaacccttttataaacaagttggccaaatcatttagtcaatcacgtcaacctgtctaaaataagacaggtaaaaaagaaaatgccatctcctagaatcgaaccagggtttcatcggccacaacgatgtgtactaaccactatactaagatggcgacttttcaacggagaactgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaccgtatccttattttgtacttttgtgtaaatatttaatgaattgtttgagcaattacgaaattgtttggaatccaaaggaatcttcagtaaatttgttggaatagaaattaattggcttctattaatcagtgcgtatgttactggtatattgggaatgggtgaacaatttgagacagttgttggattccattgttgttaaaggctgcaatattacgtagaacgaatatgctgcaattctcctcgagaaaaaataggaatctacaaaaggcgaatcgatagctctacataataatgttactttatcttcttccttttatactttgtcattctttttcttattacgttatcagttcttgcatttcaggtgctattatatttggtgactatttctcaatctctatgacatcttcttataccgtacgtgataatataatagtgatatgaataccagtcgatagacgatagttagttgggttttatttaacaaataggttcccgagaaaaagttctaatattttctatttacccaatagtactaccccatcaaataatagaatcatagtaattatcagtaacaaaatatacagccctcatcagcaatgtagtctcaacaactgcccccagaattcaccgcttttcttcgatcgtcaatatggaagtgaggaaactcgggctcacttaaaacgaactgcatgttttaaaatcattatccatgcaagtgtggcataaaagccgtagttagatatatctcaaacgcgcaaaaagttaaaaagaaagccctgtagggggctcgaacccctaaccttatgattaagagtcatacgcgctaccgattgcgccaacaaggctcttattgttgtttttctgattcttatggagggattagtgagcaaagtaaagtacttatatgtaatttaacattcgatgaaccgcggataattagtaatatgaaatgggtgatgttcataatgtagagaatgtggattttgatgtaattgttgggattccattgtgattaaggctataatattaggtatgtagatatactagaagttctcctccaggatttaggaatccataaaagggaatctgcaattctacacaattctataaatattattatcatcgttttatatgttaatattcattgatcctattacattatcaatccttgcgtttcagcttccattgaaaacgatgactatttctcatcatttgcgtcatcttctaacaccgtatatgataatatactagtaacgtaaatactagttagtagatgatagttgatttttattccaacacataattagaatttaaaaggcagtattggtgaagattgaacattaattttcttatgcttatataatagaggtatgaacacacgcatataggatcattatatagttatggctagtattatcatggctctggtaatttcatacatttgatgtcgtcacgactcatattatttgctcatatatataacttcctcatatatataacttcctcatcaagttcaattaatagatctttagttcaaattcagaacattctgaatttgtcgtttaacatttccttctgcaagagtacattcatactggaacgtatacgaggtgtaaattggtatactgttggaataaaaaccaactatcgtctatcaagcgaggcgctgaaatcctactattcgctcgaaagaccgctgaacgcaggagattcttttttgatcttgaatatcatttgagtatttttgttctacattctagttttaggaaaatcatcaatctatggcaggaatcaatagtgttggaataagaaatgcatatttgcctgcgaaaaaaagttattctttttttttggttaacgtagttaaactactctgttaaaaataatgggttaaggttcatgttcgtcacataatgtttcgtacacttaaaattcaaacgctatcagtagcattacaacgtgtatgaagatcattggagaaaagcagatggttaagagcttcttgcactgaaatttgaaaatatttgtctgaacttagtagtgaaaagtggtgaatgaaccaggtttttatacatagatatatggttaagttatgaaaactctttttggaagaacaaattagtacaaaggctgaggcggattggttaaagtttttaaattaaaagtgagcttctattttgataaatcacaaatatataatttttaacagtgatgtatcatcttcccataaatgtaatgacttcttcttatgctcagatgatgctctgtgaactaagtgcgcagtccttcaaacctttccactcaggtaatcttgataaagtttccaagatggtccattctctgggtctcttacataaacaaacttcactccgtatttctccacttctttgtttctactttcatcatcaaataaacaaatctttttcgattttaaatcgctggtattataaagatctttcaaaccgtcccttaaatggccaattttacttctttctccccactgaaattcatcgaacaggttggccaacggggttacgacaccagcatacttgaccttgaatattttcagtatttcctgggcaatctcaggtgcccacgttcgtgacgcggtcattaacttaactccattatctttaagatcacctagtatacgtgggatatctttgtagattgtgagctcgtaaccatctctacatataattgtgagaacttcgccattactacttttaactggcttaaagggaccgtgcaaatgggtatcacaatagcagggccaaatggtgtagtccaaatcgaaggcggccacgtcagggtatccagtcataataaacgcgttgagactattttggagcaggatttgtaacaaaattgttctctttgtaagtttaaggacaaaaatgcttgtttctcgagaaggtctccttttcggcaggtccttcttctagtgcgtgaaaaatattctactcaatcccttagtattctttgtaaacaatacactttaaagaaatatgaatgcttatctgcttttcaacaatcattttagagttcttattcactgaggtgcgaatgggtacgaaatttgtttcaggagaatttagcttgttgcacacaaatttctgccatttatatctgcaagatctgtttccctctttccaactagcgaggcatattagaaaaagagtgaatagtaacttgtgtaagttttgatgtaacggtagtatagagtacctataatattcgccgattatatactcaaaacttgtaaataacgccatgtcaccgtatggagaaagtgctaaccaaattgtaatatcgaccaagacctttttctgtgaattatgtaagtttcttaaagtccatgtcatgcttgaaagattttaatcaaccttgcatttgtggtcgttaaactcaaaggggatattcaaacgacaatcgacaactaacttcgaataaactaagattcactttattgggatataatcaattacccttcattaagtggtgtatatgttcctgacgtattgtcattttcggcataagaggtttgatgactatttctcgattttcatgtcatcctctttacaccgtacgtgataatacactaattacacgatataactgagcaatgatattttagagcttcatctccacaatttcatgtgtaaatcttaagaattgtagatatatttttttttaatgaaaatttttcaacaaattaggtttcgtggtctagtcggttatggcatctgcttaacacgcagaacgtccccagttcgatcctgggcgaaatcaattttttttttcgaaaacgttataatttacgttaatttacaaagggcattcctttcatactaagcaatgtttacttccaatctcttgagacatcttcgaaactagttgaaaagagacaaatccgcttaataactaatagttacaagaatggccaatcaaactcttgccaagcgatacaagctttacaatcctgtaacaaaaacatacttttagcggttccgacggtattcttctttttctccatatattttgcttatgttggctactttaaaataattaccgcttcccccaccagaaactaaacatgagctaaaggcgcaaaacttaaaaaattacatagccaagactgttttcaagaaaaaaatatcagaccacatttgataaagtacatacctctgttaactcccgtaatacacccatattcttgtactttctacaatctatcactcaaacttctctattatccaacatctgctgttgcgtagtaaagtaggccgtaaacgctcaaaactgttatctttaggttacccttatgtttgaatcgtttatctcacattggcggtgttttcccctctcctgtgggctccaaaatcttggccgtgggaagcttcagcgagggattgtagatgtagtttcaacacgtcggctgatttatcccgattttgttagtagaaaaggttctacttcattcttgcttgagacgtcgtcccatcaaatttctaacatagtcttttttcaaggaaggatatttttcaaagcaggactgcaattagtcttttccttttctttactccccttccatcataactgttagtgaataaccacttatatagcataacacaatggatcaagaaacaatagacactgactacgacgtgattgtcttaggtaccggtattaccgaatgtatcttatctggtttactctctgtagatggaaaaaaggtattacatattgacaagcaagaccattatggtggcgaagctgcttctgtgaccttatctcaattgtatgaaaaatttaaacaaaatccgatcagtaaagaggaacgggagtccaagtttggtaaagatagagattggaatgtcgacttaattcctaaattcctgatggccaatggtgagctgacaaatattttaatacataccgatgtgaccagatatgtcgatttcaagcaagtttctggctcctacgtttttaagcaaggcaaaatttacaaagtgccagctaatgaaatagaagccatttcatcgccattgatgggtatttttgaaaaacgtagaatgaagaaatttttagaatggattagctcttacaaagaagatgacttgtccactcatcaaggattagacttagacaagaataccatggatgaagtgtattataaatttgggttaggcaattctaccaaagaattcatcggtcatgcaatggctttatggaccaatgatgactacttacaacaacctgctaggccatcgtttgagaggattttgttatattgccaaagtgttgcccgttacggtaaatcaccttatttgtatcctatgtatgggttaggcgaacttccacaaggatttgctcgtttgtcggctatttacggtggtacttacatgctagacactccaattgatgaagtattgtataaaaaagacacaggaaaatttgaaggggtcaagactaagctgggaactttcaaggccccattggttattgctgatccaacttattttcccgaaaaatgtaaatctactggtcaaagagttattagagccatctgtattcttaaccatccagttccgaacaccagtaacgcggattctttacaaattattatcccacaaagccaactgggaaggaaaagcgatatatacgttgcgattgtttcagatgcgcataacgtttgctccaagggtcactatttagcaattatttctacaatcattgaaactgataaaccacatatagaattagagcctgctttcaaacttctgggaccaatcgaagaaaaattcatgggaattgccgaattatttgaaccaagagaagacggctctaaggataacatttacttatccagatcatacgacgcatcctctcatttcgaatccatgactgacgatgttaaagatatttacttcagagtaacaggccacccattagttctaaaacaaagacaagaacaagaaaagcagtaaattcatacctttacgactaaagcagcaattggagggtaaacttattttttccgataatgttcttggcaaatgagttaccaataaatgacatgaattacagaaaacaagaaaatatttgccaaaaaaaaaccaatacaaaaatataggggaaaagattatcctttattcctgtctcattccacttttttttttgttatatgcgtattctgattgattcataactaagtatctttccttttcttttctttcaatttcttttttccatatataaatacataaatttacataccttatgtagtataatatatggaagaatgctactgaacacatcagtacacatgctatgtacttacaatcttagtaaggtagatgtaggtctaatgcttcgatgatcccttcattatttcttgggtataactgtcagtctcgcaccgcagtgtgcccttgtgtggccagcctcgtgacaaaatgaacattttatcttattttttttctttttactactctttttgctggttactccctgaatagtgctcgtagttttatctgcctcttccttggctttaatcggtatcagggcatatttttgatcgtctttttccatgatctctattccattccgcagtaccatgtcaagaacactagtattcatcatacttcccacagtgctttcatgcaatcccagtagtaggttaatgaatttctctaattctttcaacttatgctcgtactcaacttgtaattgtgatccatctttttgctttgaaatgatcaacttagccaggacatccatagcttgtgacaatctgactatatcattttcagtcttatttgatgattcacacattccttgttataacaaccctcggtattcttttaacaaacttacgatgactatattgtattagtgtcaacctcatcgccaggaacttttcattgaaaatcttctgacaaattttctgtgtaaaggaaagaaaatggagtataaaatcgaaagtttattccaattgtgctaggctgtaatggctttctggtgggatgggatacgttgagaattctggccgaggaacaaatccttcctcgcggctagacacggattgcacgccctttgggcaagggatagttctctattccgcaccgtgccctgttgtggcaaccgtctttcctccgtcgtaaatttgtcctgggcagagctgtctgcccggaggcgggagagtccgttctgaagtgtcccggctgtaataaatcgatctttgcgggcagcccgttggcaggaggcgtgaggaatccgtctctctgtctggtgcggcaaggtagttctgggtccttaggggctccaccttcaccgctgttaggggagttttatccagcgtcagcaaaggtgacccgtgatggaggcggccgggatagcacatatcagtcggataattgtgcaagttgatcgcttcggcggtttaatttggcggtgccatcaggatttactcgcacattgtggccgttccctcggggatggagtgtgtcctgaaccatattttttaacatttttttgaactaattaaccgtcccaatgggggatgttggaagagtaagttaatgtaatgtcctattcttgttcttttcgaatataaatgacgattggaaggtgcatgtcaatgtttatcatcatgttcttgttgtaggtagtccttaccttggttgtagagtgagtagcgacaggcggcagcggaatataagaaggataaaatgagaatacttagaacgtgttgaaagaagaataaacgatcatccatcgactaatactgctgctactagtgtgctgtcatactactaatatattatcatatacaatataagaagatgtcataaacattgaaaatagtcatcaaatctaatggaagctgaaattcaagggttgataatgtaataaaataaagaatgacaaagtataaaaggaagaagatagagtaacattattatgtagagctatcgattcgctttttgtagattcctattttttctcgaggagaattgcagcatattcgttccacgtaatattgcggcctttaacaacaatgtaattccaacaattatcttaaaatttgtctatatttttaaaaaagtatgaacaattaccaacatgtggtacatattggaggcccgcaaagctgagttggcattcattcattctttaagttgaacaaaaagacaaaaagattttcaaaaaaaatatggtctctagcgggatcgaaccgctgatccccgcgttattagcacggtgccttaaccaactgggccaagagaccaaattttaatgaaatacttttactggaaagaaggtaacaaaccatggaagatgcttttctaccacccatgaaagtctgagatttttattaatgaagaaactgcttatagtcaattgaacgatttaccggtattttaacgccattatatatattagtaaaaagatggcgtatattgatggactaacagggtcaaataaaatcatgaattgactagtatatacttataagtatatcgttctacacaaactaggaagatgacatacatgatgagaattggttatcaaattccatggatgccgaaacgtaaaagatttactaaatagtaggataattattgataacatacaaaacaaaaaaaaaagagacaatattattatctagaagtgtcgacttccttctgtgggtttcctatgttctcgaagagagcttcaagtgtattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatccacatgctctacactaagaatattagtttaacgaaagatcgaagtcagacacctatctaactttcattaaattatcacacaaaaatcccacatactctcgtcttgctaaacaaataataaattgaaggtgaacgattcttcttgcagcgtcctagctgttgggtcgtcttagataaatatctactgttctgaattgccaaattttccttctattgtatccattcgatgctggacggccagttctaccgttattgcccaaaaggaaggaacgtcgcgatacttcaacacattaaatacttgttgattttcgaaccaaaactctgaagcaacactttcgtatatggatggcccttcagagaaaccaataggtatgtaaagaattgctacgtggtgactcaaagtgaattatagtaaagttataaaagcgctacattgtagaaaattgagaaccacattttgacatacacgaataacagtatttttgtcctggcgctgtaaagtattttaagttatgatgatgaattaactattttcagccaatgaaacgtccataatctgttctgaatttaggtgcattgatatagccggtcaatcttcccttgtgaaatcacccaaaatgctgggattatcattctcaacaattttgatttgtgccaaccacttcgataaatcatcttccagctcagtatcatctttttctgtagtcccactgtcaggatttaatcctaactttttgagaccggatatcaatgatttaatgtcttcttcggatgccttttctcttagcaactcttcaaacaaagtcactttgaaatctatatcgtgtttgtcctgttcaggatcttcaaataggtgaacccctgttcttgcaaataaagcttcatcagatagttgcacttgataaaattgggaacatctaaaatggaacttactgcaatagtgcgacaaatatgcatacggattgttttctaataaaaatttcttagtagtatcattcattgaaaatggatcacgtattctttctggcgatttaccgcaaagaggatatccgcatcttttgtttagattcctctcatctactaggtcttgatacatatccggtgtgagaaatcggcccaaatatttcaatgttttctcatccttgcattctgaatcacataataagcctataatctctaaagttataacttctgcttcatgcatggaaagttgcctgtgcttttggaaagggattaacgccgtttccttaatatcttcaatcgtcgccatttcttattcttgttaacttcgtcctaatttttcaaactaagatgccgatgtatagatattttagactgggaatgtttatgaattgttcaattcgctcctcaatgtgtctctttcttcacttttccattgcttttgaccacttctggatgccagctgattttgtattgtagtattcctatttcggacaaaaatatcggaaagagatgaaataagaaaattagttacttttaatatcacgatgctgtctctgaatcgacctgatcgatctataaggtgtatatattattctaccgagtaatccaaaaaaaaagcagcactcccatgcaacacaaggatacggcagtagcgaaggacacagctaaaaaacgtttactgagaagaaatagtgcgccgtcagctatacatataatttcacgattagacaaaaagtggtccttcctatggaatactatagatagacacaatattgttgaagagcaagatgaaagtagcgctgcaaaaagcgaagaagaacatgaggatgattatgaattggaacaattactcaacatgataagaataccaatgttcctggaaaagttcatgctctttgcacttttaacaagcttggactgttttttgtattactttactgtattaccgatacgactgataaagggatatgtaaagcaattcaagagttatcgtcagcattatcgcctgcaacaacggtctgggcataagaataaaataccctttcgatatagaataacttcaagagaatataaagagagatgtatgatttttatcatcgtgatttcatccattttgttgagcaaactagacacctcaaaactatatcacaggataaaacggcaaagtacgatgaaattgtacatgctattcagtgtactggaaatggcggacaaaatgttggcaagtttgggccagagcttattaacggttatgctttctaggaaaaactcggaacggatattactgcataaatgtttgttagtgtcaatgagcttgacatatgtgactatacacggctatgtattggtttaccaggccatttcattaaacatagccgtgaattcgtattccaatgccttgctaactttattactatccatgcaatttgcagaaatcaaatcatcggttttaaagaaatttgataaggagggatttttccaaataaccattgcagacgtagtggaaagatttaagttgaccttattattgtcaataactggccttaggaacctccagtcgtggtcatcttcattatcgaacacaagcatcaatttctggagtccacgttccacattatcaatcgtcattaacatactttgtgggccgatggtaagcgtggtagggagtgaagtgttagtggattgggcaaagcatgcttacatcacaaaattcaatcggatccgcccacagatatatgataagttctattatataatatacaaggattattctacgagaacgcacaaattagaagatagattgggattgcctttacctgcattcgttgtcctttttattgtaatggtgaggccaacactttttaaatcatcggaaccttcttaccttccttcgctatttaggatcctcttcatgggggcatccgtgtttttactagcattgttggcaaaatttacactagatcttattttaatcaaatggagcaaacggatagagcaacggttcagagaccaagctttcaataccgttgtaactgaagaagaatacgtcccaggtttactctcgggcggtatgggtaaagtcgacgtgtctacaagaattgcattacattctgattacaataaagagaatcgtatagagaccgaaagtgtatcgccaatgcggaaaagaaaaactactttaactgctgaatgtactcctcctagcctaaatgatattagaagacagaaagattccaagaatccacgatcgcttgaaaatgtcgctcgctataaaatggtttctaaaagaatatggtaatctaagatccgcatttatcgcggcttacggctttcggatatttcgtatattgcaaggagcaaaaaagaaaccctgcttactaaaaagctattgttttgcagtttataagttcttgccttttgaattattgatctttcctttatcgtttatttagtttcctattgtaacttggaactgtattatataatagtgcacagcactgaagttgtaactactgtacgtcatgcttttcagaaacatagaagtgggcaggcaggcagctaagctattaacgagaacctcgagtcgtttggcctggcaaagtattggggcctcaaggaatatttctaccatcagacaacaaatcagaaagactcaactatataattttaagaaaactgtgagcatccgtccattttctctctcctcccctgtttttaaaccacatgttgcttcagaatcaaaccctatagaatcacgtttgaagacctcgaagaatgttgcttactggttaataggtacatccggtttggtatttggtattgttgttcttggtgggttgactagactaacagaatcggggctgagtattaccgaatggaaacctgtcacaggtactttgccccctatgaaccagaaggaatgggaagaagaatttatcaagtataaggaatcaccagaatttaaattgttgaattctcacattgatttagacgagttcaagtttatattttttatggagtggattcatagattgtggggtcgtgctatcggcgctgtttttatattacctgcagtttatttcgctgtatctaaaaaaacttcaggccatgtcaataagaggttgtttggtctcgcaggtttattaggattacaaggatttgttggttggtggatggtgaagtctggtcttgatcaagagcaactagacgcaagaaaatcaaagcctaccgtttctcaatatagacttactacgcatttgggtaccgccttctttttatacatgggtatgctctggactggtttggaaatattgagagaatgtaaatggattaagaaccctgttcaagccattagtctcttcaaaaaattagataatcccgcaattggcccaatgagaaagatttctttagctttgttagcggtgtctttccttaccgctatgagtggcggtatggttgccggtttggatgctggttgggtctataacacctggccaaaaatgggtgaacgatggttccctagttctcgtgaattaatggacgaaaacttctgtagaagagaggacaagaaagatctgtggtggaggaatttgctagaaaacccggttacagttcagttggtccataggacatgtgcgtacgttgcgtttacatcagtactagctgctcatatgtacgctatcaaaaagaaggccgtaattccaaggaacgcgatgacctctttgcatgttatgatgggcgtcgttactttacaagcaacacttggtattttaactatattgtacctagtcccaatatcgttagcttctatccatcaagctggtgctttggcgttgctaacaagttctttggtgtttgcctctcaattaaggaagccaagagctccgatgagaaacgtaatcattaccttgccacattcaagcaaagtaactagcggtaaaattttaagtgaagcgtcgaagttagcctcgaaaccattataatggataaaggtattcttatgagaattgacagtatactcgcttttccgctttgtcgctccaatggttggattgtatgtgtgaggctttttcttattatatgttggtatccctacgagaagctgtaaatatgaatttctttagtaggcatcacacacaacaatagggtgtatttatttttatttttttttttcttatataaatgtcagtaatacatgatatctttaagttaggatttcacgaaattttcttctgccttcatcatggcatctgtatttgtgctcgcgagcctccaaagtatgaacataaacacagacctatacggagaaaatgtttcagagcatttttccattatgtcgtcgtcatatattttccagttgtatttcttatgcttaatcttactctttttaactacttttctttcacgcattaattctttttccaattctggcttatctgaaaggtattttgaaaaacccctagcaatacctagatcttcaggagcaaatacatccattcttttcaatccggagatcaagaacattttggcactccatgggcctataccttttacattcgtaactaaactttcaatcacttcctcatcattatctttttgaccgaagagcttttcgatatccttatatttttcagtaaaatagacagcaagagactctagatatatcattttccttttactcaatccacattttgcgatttctgcacattttgctgggtctttgaagtcttcgaaaaggactttgtaatcaggaaatgcaccgccataaagactgacaacccttgccttgatgctttcagctgcttggccactgatctgttgagacaaaattgtgcttgcaagcctaataaaataatcttcgagtgtattagggacttgagtctccttcaagtacaacgtaaattcattattcttaagtatgggaaaaagtgatggatctttctctaaaatgtgttcgcaagccatattgaacttttcttcatgtctagcaatatatttctcaggaagagcaacctctagaggtcgagaccctaattcttttgctatttccttaacagcgtctgcttttattaactcatcatactccctttttagtttcattgagaccaatccctctctagcttctcttgattctcagtaaaaaattaaaaaggaaaagtaccacttccatcgtcatatcagagggcagtggccaattctcattgattcatagataacttaaactttatgtaagaattcccgtcgccaccccgccctgtaaattcatcgccaccgaaaagataataataccaaaatgatatataaagtaggtcgaataagaaagtatacttaacgtagttaacaaagtacataccaaacataacagcaaaaatatacgtaaagatggatttaacaatttcaaacgaacttactggcgagatatacggcccaattgaagtcagtgaagatatggctttaactgatctaatagcattactgcaggccgattgcgggtttgacaaaacaaaacacgacttatattacaatatggacattctagactcaaacagaactcagtctttaaaagaactagggctcaaaaccgatgacttattattgattaggggtaagatttccaattccattcaaacagatgctgctactttgtccgacgaagcgttcatagagcaatttagacaagagctacttaataatcaaatgcttagatcacaactcattttgcaaatccctggattgaatgatttagtaaatgacccactgttgtttagggaaagattgggcccgctcatattacaaagacgttatggtgggcataacaccgccatgaatccttttggcatcccccaagatgaatatactagactaatggccaaccccgatgatcctgacaacaagaagaggattgcagagcttttagaccaacaagctatcgatgaacagttgcgcaatgctatcgaatatacacctgaaatgtttacccaggtccctatgctttacattaatatcgaaataaataactaccccgtaaaggcatttgtagatacaggggctcaaacaacgattatgtccaccaggttagcgaagaaaactggcctgtcgagaatgattgacaagagatttattggagaagctcgtggcgtaggaaccggcaaaattattgggagaattcaccaagcccaagtcaaaatagaaacacaatatattccatgcagttttaccgtcttagatactgacatcgatgttttgataggactagacatgctgaaaaggcatttggcttgtgtggacttaaaggaaaacgttcttaggatagcagaagtggagacaagctttttgagtgaagcggaaatcccaaaaagttttcaagaaggacttccagcaccaacgtcagttacaacttcgtctgataagcccctaacacccaccaagactagttcaactctaccaccacaaccgggggctgttcctgcgcttgctccaaggactggtatggggccaacacctacgggaagaagtacagccggtgctacaacggcaaccgggagaacgtttcccgaacaaacgattaaacagcttatggatctaggtttccctagggatgctgtggtaaaggctcttaaacagactaacggaaatgcagaatttgctgcatccctccttttccaatgagcaaccactgatattgtgatcggcctctacgtatgtagcccataacacaaatagataagtataaggatgtacatactttcattgtttcgtcaattgttgtttgtattgtatatgattgtacttctgttaagtatataatatgcagattgtatttgtgcctcaatgtgcgccattcatgtgttgcaaaccggtaatttgattcaaaaaattctttcgtaaaataaaacatatgcactgggtgtgataaattcagtactaaacgttataggacgataaagcgagtcatcgaaaaaataccaacctttttttggtcccttataaacgtatgaagtatagtgtcccccatacaaactccccgaatgacatgcaaccccatacagtctgtatctaaatggtggtacttggcccctggtaggaatgtcctcattaacaatagcttcatgattaaaatctctcgcccaatatggtgtaagatctaaggagtaaggatattggacaaacacattattcttattcatttgattgtcaaatcgtttcaaattaataattagtttcttaggcaatctagtaatcttcagttgtttagtggaaggctgcttttttaagcatttaggacatgaccattgttcatcgacacctaacctttcgcatttggtgaattcccggaaacagtctaatatgttacaagttttaacgcgtgggacaggaacagaaagaacagagaatgtttggtaagttgtggaggtatgttcacaaacttgacattgtagcctagatgcgtactgtccttggaaaaggtcaattatcgcactgaagtcggtaagcaaaaatctttcccactcgagagcactagctttgcgtatggacattttttctctcattcgttcttcctcatctgataactgtttaagatgctttttgctgccgttttggttcaaatcctcgtgcaagccatcaagcaaaaattgacaaaattcttgacaatcttgctgcattgaatcactatacatggggttgatatggccgcaaatttttttaaactgaatagtctgaactggtatcgttcttacgttaggaggtgtgaatgcaccgtgtctgtgcatattattgaccaagatggcgaaatttttagctagcaaccccttagaacctcttgaactatcaaaattaataaaattcagatatgtgttatccaaaaacattcgaaccaaatcgtgtgttcccaccaaacattgaagtatacagttcatataacaacagttacctatattttccaatcctactataagatctagatcaagcacttgtgagttgtttaggatggtctgcctcgacgaagacaagttctgttgtggtaaaggcggaatacgtggcgagaatacattcgatgcagggggcaaataggcatgggcttgtgcagcgcggatatctggcgatattctttccacagtgtttgctttattttgaatggtcgagggtgtattgagttttgagagagtggttggtggatgtggactaaatttttgaacggtgggagaatttctgttggggcttggttgcggtataatgggcaaatctgaatagtataagggtaattgaggcctttgcaccgttgttagcaaaggctgcgtattcatggataccatcggcatactcttatctttatttggagatagagatttctgattgaacaagcctgttgggacttgcggactaccaaaagctggcgttgaagacgaggatgtaagatgcgctgtttcactgacagatgattgatacgccccacctaatttaacccagtttgagaacccattttccaaaatgagtattttcgtcccactcagcggtttaattactgaattttgggaaagaatcttcgcaaggatgcgagtttgcctttgctggaaattattatgcaattgagtgtcagtatataaaataatgaacttgaacttgtctcgatttgaaaagaaagtgatatctgagtgcggcgaagtgatcaaagagacactttcaatttgttggtctgtaaaagaatccttaaatgaggcaggatcgatgcatataatgtttttgcatttgatatgggccctaacgaattcagacctgggccgtacatcgataagcaagagagcgtcaccatgaaaatgcaacattgaacttaattttccaggctctatagtttgcaactgtataaatttagggtaattttcaatgacatttcgaatccgctcaatatttgggtcattatgcaaaagctggattctctccccgtacaaatttctaacattctggtccttgttgctcgaaaattcctttagtcttggtagagtatcctccaagagcgtatatacgatcatgtaatataaaaaagctgtttcattcaatcggagaaacccctttgacaaccggtttgcatcttctttaggggcctgcatggttatatcctggcatgcgtccacataactagaccatatttctgcgcattcttggagcaaaggcagacactcttgtggcacgtcgtcatcatcaagaaacttctgaactaaatgcctaagcctgccgaaccgctctttagcagattcgacaacctcacttaaggcttgttctgagcccattacgcttgtgcctatttgtgtagagagataataaagaaaggactccacatacgttggagaatacctagcaactaaatatagctggtgtttacttgatgtgttgaagtgaggcgcaaggaaaaaagaaaaaaaatcaatgcccggtagatcaattggaccaggggttcttgttttgcgacgccgtacagacaaggccaactttataaaaacgatattagaaattattgtatatatgtatataaatgtagtatttttatcaacagaaaataggtggaaaactcccaccctgtgctagacttcattcaaagagagtcggctttaacgtggaggacttccttgtctgtggcgacgttttgagacgaggaatgactggtagtttgctcgggaagttcgtagttctcttgcacattgatctcaccatcttcattgaagttgatgttctccatcttggcaaacagttgtctcttttgctcttccgtcaactcctgctttttcttgttcttgatccagtatcctgggttcaagtgtttcaattgtaagtttttggtgaaaggcaagtgaccacgcctttcttcgaatatcattaaactcaacacaatgataagaaccaaccaatagatgttgtaacaaagcatggatgacaagtagccggtgttctgccatccaagcaaagcattgaagatatcccacccattgtccagttctgggttgcaacaattgacatggtaaacggcctttctgatgttataagacccattaccatcaccgccttcggaagcatcaccaccactggcaaggttgaatctgtaattttcaaagtaccacgcaccacgagagaaaagaccggcggagatcaggtacaagatcgaagtagacaaaatcaagaaaatctgcagcgaggatttcgaagcaccatagtacaacaaatacccaacaagaccaccacatatcaaaccaaccacaacgggcaatgggtaagcagaggcgtgcgagccctgtgtggtaatacctgcaccggcaacgaacacaacagcttccaaaccttctctcaagacagtaataaacggcaaaaggaacatagcatatcttctactcaagaacccaatcttgaaatagtctctcttacggtgaggaatctccaccaacgaccgcgcaatcttcactctccacttactctgcatcttattcattctcaacataggaatacccatcatcgagatcattatcgtcgcaatcatacaaaagataccttcccacaagtcttccgcgcttccgaaaatatccttctgcagcgaatagtacgcaccgatgaaacctgcaccgatggccagacaaatgatgaacccgagtaacacaccgacccaaacctgaatccttaatttacggtacagcgcccggtcatgttccccgattgcctgtttcaaaaacgatagcagcacggaaataacaatcactgcttccaagcactctctgaacacaacgaagaaaacggccacgttaaacactttgttaggcatggcgggaagtatatgtgtgatgacctgctgagagaagatttcgacaacgtacaatccgtcgtgttatgtatttttttgctcacattgagcattttatataactaaaagctcaaggtcgaactacagcccatcgcttccaccgggccttgcaacaccaacttagaaatcgggtgcattcatctacgctgtgcagagaatgaaatgcgcaccttcttactgctgcgacggtgctcggcacggcttacgcgggcgggggaaggaaatagcggcctggcgtgagtcggcagtcagcggcgggctcactgtactcgctcgtttaatgcaccagcagtattcgcgcacttaataatagtatttctgcaccctggcctggaaagaatgctcgatgcgccctggttgattggcgcagagcgtgtgtcagtgccggacccgatttctttttttctacacgttggtctgatgtctcaggagttagtagtgaccgtggtcaagaaaaaaacaggacgaaaaattgttgagaacgtatacgtatattgtattcttcttttttttctttgctgcccttttattatctatttcattttttaaccagaggcaatcgtaagagagagataatatagccctttttggtcttttttggcaccttcagccggaccctgctcttttattacccggatgctcgggttttgtctttgcatccgggtagcaaaacagaatacttgctttcttattgaagtagaaaaaatacagagaaagcgaaaaaggcttccttggcggatagatggtctcacaacaagcatagcgtatacacgtgcactcacaagcatacacagaagcgcgcaaaatgagtctaccggagattttgcctttggaagtcatagataaaacaattaaccagaaagtgttgattgtgctgcagtcgaaccgcgagttcgagggcacgttagttggtttcgacgacttcgtcaacgttatactggaagacgctgtcgagtggcttatcgatcctgaggacgagagcagaaatgagaaagttatgcagcaccatggcagaatgcttttaagcggcaacaatattgccatccttgtgccaggcggcaaaaagacccctacggaggcgttgtaaaaaggcaaaaattaacgcgaatttgtatagtgcatctaaaaaaaataattaagtataaaaatagataaaggaaatcaagtgtttctttttttttttttggtttattgtttgacactggtgatttgcttaaccagcgcctccagcttcgcgttcgtgagagcgacgtcttttccccgcatcgccaccgtacaattcattaaatgccatattccgatcacgtattggaccttgcgcatgccgccctgctggcggcacatatcgaaacactttgctgaaatcgcatagatctcgcccagatcgtgttcgagcattcgaccgcctaagtagtttaccagtatttgcagcaacagagccttcttcaatttgaagcggttgtccgcaacggcttctccggcaacgaacttgttgctagagtagaactcgcggagcttcgacacgtactcggcgcgctgcttgtcactacatggcagcgggttccaactgaacggctcgaaatggctgaaaagccataggatcgttactgtgcactcccatatggggttgaactgcagatccgtttcttgtagcaatttctccacctgaagccacaccttgttgcattgctctacgagttcgccctgtttgtcccccgaacatcggctcactcttgccgcctgcactgtgtagcaattcagaagcgatatcatcttcacctcgctggatgtaccgccagattgtgcaagccgcgtgtactcttctacggccccgccgccttcaaactgaaccttcatggcttgcagcagcctcacgtagcctggagagggccctaacttaggtgactcggtcgtcactacggcccccttcaagagtgtttgttcccacactttgtaaaactcacagaattcaagaatgctcttgtatgtctggattcgtgagtccagctcattcatcgaaacaccgccagcggcaatgttcttaatcagtttctgcgttgtagaatagactttggggaggaacttcctggaaaaattgcccttttcgtcataacagttcacgatgtagctgacactttgcaataataacagtatgttctttaattctttgtagtggaaaatcataggcaactctactttcagcgctatccttggcatgattttgatcacacatcccttaccttcattagtgactagagattgcttgtttgtgtcaaagaaatttttgaattcgttcaagtggtccgtaatattcccgtctttacaaagctggattaccatctctaatgccaacttccatgcatatagctcaggccccaccgtgtgcagctccgtgcttcgcagctcctgcagagcatcctcggggattgggaacctctcatttagcaagtaattcacataacacagatttagaaaccatttccattgtgacttttcccgacattgcgagagtagcccatgaaaactcgtcttcaccctgcggtgctgtttcagcttaatgcaaagcatcacgccgacatactggaatacggatgcccaattttgatacaactcatcctgcaaatttaccatgtactggactaattcattgcaatttcttagtgcaatcttatagtggaacttactgtctctcataagtggcaagtcatgtaacagcagaaactcgcaacgcatgatctcttctaccaaatctgtgtcgctctggtgcgtttgtaaccgttctttcaaactggaaatgtaaagctctgctaggtcaaaattatacgtctcctgtatcaataactccaccatctcaaacgtgaccttactatcctccagaactgaaagcgtacatttcgttttcaatagctgaaacatctggatagacatgttcatgaggccataatactgcttcaacccttcctcagaaccgattttattcgcaattgaatatgcatggtctctgtattcctgtgctaagtggtatacttgtgaaatactaagtttgtcgccaagattttccatgaatttgtacttctttcgaaatcgttcaatttctaccaatactgattcccctctgatagctgagatgtcgggattccctttgctgatagatctaactcatctctttacgtattttaattgtgaagccgtaaatagttatcttccaagtttctcttacgcgagctttttgggaaaagaaaaaaatttgaagatctacatataaaacatggcttcaaaggattactaatgactttttttaccttgataggtattcttgatggtaagagtaaacaagggacgtgaaaattacagtagttactgttttttttggactataagatcgggggaaagataacacataagaaataaaacgactactagttagactgctctgcggaagaagcaaggaagtaaaggctgcattttatttttcttttctagtccaacataaacaggtgtatcaagagaaacttttttaattatggccgatgaggaacgtttaaaggagtttaaagaggcaaacaagatagtgtttgatccaaataccagacaagtatgggaaaaccagaatcgagatggtacaaaaccagcaactactttccagagtgaagaggacataaaaagagctgccccagaatctgaaaaagacacctccgccacatcaggtattgttccaacactacaaaacattgtggcaactgtgactttggggtgcaggttagatctgaaaacagttgcgctacatgcccgtaatgcagaatataaccccaagcgttttgctgctgtcatcatgcgtattagagagccaaaaactacagctttaatttttgcctcagggaaaatggttgttaccggtgcaaaaagtgaggatgactcaaagctggccagtagaaaatatgcaagaattatccaaaaaatcgggtttgctgctaaattcacagacttcaaaatacaaaatattgtcggttcgtgtgacgttaaattccctatacgtctagaagggttagcattcagtcatggtactttctcctcctatgagccagaattgtttcctggtttgatctatagaatggtgaagccgaaaattgtgttgttaatttttgtttcaggaaagattgttcttactggtgcaaagcaaagggaagaaatttaccaagcttttgaagctatataccctgtgctaagtgaatttagaaaaatgtgatggggaaggagtagacgaaaagaaaaaaaggttttctatttgttccattttctcaattattaatggtcctcaaagaaataaaagaaaaggaagaagaagtaattgtaatatcaaacggttttttatagtatattcttcttattctatatttatatatcaatgttttataataagatgtttattcatagcatatctggtggatcgtctctattaagcgccagcgaggtgtttgcctctgcatttttcagcaaagcaagctccctttccagcttgaatctatgttcacgctcatccgacaattctttttcatactttctttgtgtactcgtaagcacttttttaaactcacttgtcattattgaaagtgaacgtgatccagaaccgcttgtggggcttcctacagaggaaggtgaacttggatcccaagtcaccggcgaactcgctggtgatgacatgccgaaattatgtctgcttgaattcagcttgttgttggctttttcaagttctttattttcctgctccaattcgtgtaatttcttttcagttttactcaaattcgagtggttgtttaataacttatcttgtaattctctgttagtccgcgttagcttctcgatatcttgtacatattcggcacggtcattctcgaattgcttagtcaagaaattgtgtgccagttgcaaatcactaaatgccgtttctagttcttctaattttttagaggagtcttcctcttgaattgcagcggcgttaggcgaaataggtggtgatgacgtatttttttctagactgacgcaggtatccaagatagaatttatcccatttttcaagaacttcacagggtcatctaatggtattggcttgatatcaatgcctttctgaatggagtttgacatcaagaaggacgttaattcttgaagtatttcatttttatcgtcatcagctttgtcagtatggtaagcacccttgttaaatttatctgtgccacccatattagtggaagacctcgctcttttagaatttgggaaactgttgttgttttccttcgtaagctggtctatccctgtagtgttaatggattcaaggatcctcagcatcatttcataccaatccgcagacttcggctgcagcttcagcaactcattgagtgtgggatttagatcatcagagttcaagtgctctttttgaacgtagtatagggcgaactcagacactagctttttgtcaaggtctatttctgactcgtcatttttacttctatacagaagatagtcaaaatagtcaatggaagtgtatggtctactattgtgatgcggatgtgacggattttgggagagaaggtactgtttcaattcatcgtatttcaatggatactcttcgtatcgttctgcactaaaaagcaaagggttcgctcttctcgagagctctagatcaaatttatgcatatgaaacgtgatatccaccgttattctccctctcgaacacaggacttcgatagtatcttttgtaatctgttcagctcaactatttgttaccataccatcatcatcactttacacatactcatcatgtgtttattgacgcgagcgcgacttgcaagaaaaggcataattgtggcgaggtaatgaaaaatttttgacgtttccctcattcattcatacataacattttgggattttggaacaaggcgagaggagaacgtctttggaccactgtaatagtacacaatgcaagatattttaagtttatgctaaaaatccagaagtgacgcttcatcaacggtgtcaatatggaccgaattttagtgtatcttcaattgtaaccgtgaggagtagactctttgaatacgggggaagaagaaatatcatattcaaagctaattcattgaaattagtgcttgtctcatctagcctttagtgcttaatctctggaggagcacatatggggttaaagccatgccgggactgggggcccctatcggggctcgaacccgaatcccgcgagtatttatttgaaggtccgggacgcaagttacctaatctggttaattgatatcccatttaggcgatgacgttccttcccctcacccctcggcttgttagaagatctattgttatagcctcctctggaagaatttatgccagatgaagaaaaaaacttctcgaagttcccagatgcccaaatgagggctttccatccctgttagctggaaaagtgtaagtatatctatataaaaagtcggcctacttttgccaggttcgtctttcacttgcactctcttgatcttactttctactcaaaaagaatccaatacacaaaaataaaatcagtactattactaataatgttgtctaacgctaagctccttctatcattggccatggcctctacggctctcggattggtatctaattctagttcctctgtaatcgtggtaccatcaagcgatgctactattgccggtaacgatacagccacgccagcaccagagccatcatccgccgctccaatattctacaactcgactgctactgcaacacagtacgaagttgtcagtgaattcactact
